US008114968B2

(12) United States Patent
Devy et al.

(10) Patent No.: US 8,114,968 B2
(45) Date of Patent: Feb. 14, 2012

(54) METALLOPROTEINASE-12 SPECIFIC MONOCLONAL ANTIBODY

(75) Inventors: Laetitia Devy, Somerville, MA (US); Sonia Schoonbroodt, Lixhe (BE); Rene Hoet, Maastricht (NL); Nicholas Frans, Liege (BE)

(73) Assignee: Dyax Corp., Cambridge, MA (US)

( * ) Notice: Subject to any disclaimer, the term of this patent is extended or adjusted under 35 U.S.C. 154(b) by 292 days.

(21) Appl. No.: 12/397,258

(22) Filed: Mar. 3, 2009

(65) Prior Publication Data
US 2009/0311183 A1    Dec. 17, 2009

Related U.S. Application Data

(60) Provisional application No. 61/033,348, filed on Mar. 3, 2008, provisional application No. 61/127,830, filed on May 14, 2008.

(51) Int. Cl.
C07K 16/40 (2006.01)
C07K 16/00 (2006.01)
A61K 39/395 (2006.01)

(52) U.S. Cl. ............. 530/388.26; 530/387.1; 530/388.1; 424/130.1; 424/141.1; 424/146.1

(58) Field of Classification Search .......................... None
See application file for complete search history.

(56) References Cited

U.S. PATENT DOCUMENTS

| 2003/0157110 | A1* | 8/2003 | An et al. | 424/146.1 |
| 2003/0235577 | A1* | 12/2003 | Shapiro et al. | 424/94.65 |
| 2008/0187508 | A1* | 8/2008 | Cosgrove | 424/78.08 |

OTHER PUBLICATIONS

Ling et al., "Pathogenesis of cigarette smoke induced chronic obstructive pulmonary disease and therapeutic effects of glucocorticoids and N acetylcysteine in rats", Chinese Medical Journal (2004) 117(11):1611-1619.
Liu et al., "Association of increased expression of macrophage elastase (matrix metalloproteinase 12) with rheumatoid arthritis", Arthritis & Rheumatism (Oct. 2004) vol. 50, No. 10, pp. 3112-3117.
Longo et al., "MMP-12 has a role in abdominal aortic aneurysms in mice", Surgery (2005) vol. 137, No. 4, pp. 457-462.
Lu et al., "Regulation of matrix metalloproteinase-1 by epstein-barr virus proteins", Cancer Res (2003) vol. 63, pp. 256-262.
Luttun et al., "Loss of matrix metalloproteinase-9 or matrix metalloproteinase-12 protects apolipoprotein E-deficient mice against atherosclerotic media destruction but differentially affects plaque growth", Circulation (Mar. 1, 2004) vol. 109, pp. 1408-1414.
Lyu et al,. "Wnt-7a up-regulates matrix metalloproteinase-12 expression and promotes cell proliferation in corneal epithelial cells during wound healing", The Journal of Biological Chemistry (2005) vol. 280, No. 22, pp. 21653-21660.
Markus et al,. "1H, 13C, and 15N assignments of MMP-12, a key protease implicated in lung tissue remodeling" Journal of Biomol. NMR (2005) No. 31, p. 260.

Matsuno et al., "Effect of a synthetic matrix metalloproteinase inhibitor (ONO-4817) on neointima formation in hypercholesterolemic hamsters", J. Cardiovasc Pharmacol. (Jul. 1, 2004) vol. 44, No. 1, pp. 57-65.
Mecham et al., "Elastin degradation by matrix metalloproteinases", The Journal of Biological Chemistry (1997) vol. 272, No. 29, pp. 18071-18076.
Meyer et al,. "Matrix metalloproteinases 9 and 10 inhibit protein kinase C-potentiated, p53-mediated apoptosis", Cancer Res. (2005) vol. 65, pp. 4261-4272.
Molet et al,. "Increase in macrophage elastase (MMP-12) in lungs from patients with chronic obstructive pulmonary disease", Inflamm. Res. (2005) vol. 54, pp. 31-36.
Montano et al., "Matrix metalloproteinases activity in COPD associated with wood smoke", Chest. (2004), 125, pp. 466-472.
Morales et al., "Crystal structures of novel non-peptidic, non-zinc chelating inhibitors bound to MMP-12", J. Mol. Biol. (2004), 341, pp. 1063-1076.
Morgan et al,. "Differences in matrix metalloproteinase-1 and matrix metalloproteinase-12 transcript levels among carotid atherosclerotic plaques with different histopathological characteristics", Stroke (2004) 35, pp. 1310-1315.
Nar et al,. "Crystal structure of human macrophage elastase (MMP-12) in complex with a hydroxamic acid inhibitor", J. Mol. Biol. (2001) 312, pp. 743-751.
Nenan et al., "Macrophage elastase (MMP-12): A pro-inflammatory mediator?", Mem. Inst. Oswaldo Cruz, (2005) vol. 1005, (Suppl. I) pp. 167-172.
Nenan et al., "Analysis of the inflammatory response induced by rhMMP-12 catalytic domain instilled in mouse airways", Intl Immunopharmacology (2005), 5, pp. 511-524.
Plantner et al., "Matrix metalloproteinases and metalloproteinase inhibitors in human interphotoreceptor matrix and vitreous", Current Eye Research (1998) 17:132-140.
Power et al., "Intracerebral hemorrhage induces macrophage activation and matrix metalloproteinases", Ann. Neurol. (2003), 53, pp. 731-742.
Pyo et al., "Targeted gene disruption of matrix metalloproteinase-9 (gelatinase B) suppresses development of experimental abdominal aortic aneurysms", The Journal of Clinical Investigation (Jun. 2000) vol. 105, No. 11, pp. 1641-1649.
Raychaudhuri et al,. "Blockade of integrin VLA-4 prevents inflammation and matrix metalloproteinase expression in a murine model of accelerated collagen-induced arthritis", Inflammation (Apr. 2003), vol. 27, No. 2, 107-113.
Saarialho-Kere et al., "Accumulation of matrilysin (MMP-7) and macrophage metalloelastase (MMP-12) in actinic damage", The Journal of Investigative Dermatology (Oct. 1999) vol. 113, No. 4.
Schlotzer-Schrehardt et al,. "The Pathogenesis of Floppy Eyelid Syndrome: Involvement of matrix metalloproteinases in elastic fiber degradation", Ophthalmology (Apr. 2005) vol. 112, No. 4, pp. 694-704.
Senft et al,. "Surfactant protein-D regulates soluble CD14 through matrix metalloproteinase-12", The Journal of Immunology (2005) 174, pp. 4953-4959.

(Continued)

*Primary Examiner* — Sharon Wen
(74) *Attorney, Agent, or Firm* — Lando & Anastasi LLP

(57) ABSTRACT

Proteins that bind to matrix metalloproteinase 12 and methods of using such proteins are described.

9 Claims, 11 Drawing Sheets

OTHER PUBLICATIONS

Shapiro et al., "Neutrophil elastase contributes to cigarette smoke-induced emphysema in mice", American Journal of Pathology (Dec. 2003) vol. 163, No. 6, pp. 2329-2335.
Shimizu et al., "Th2-predominant inflammation and blockade of IFN-γ signaling induce aneurysms in allografted aortas", The Journal of Clinical Investigation (Jul. 2004) vol. 114, No. 2, pp. 300-308.
Suzuki et al., "Matrix metalloproteinases in the pathogenesis of asthma and COPD", Treat Respir. Med. (2004) 3(1), pp. 17-27.
Tsutsui et al., "A1 adenosine receptor upregulation and activation attenuates neuroinflammation and demyelination in a model of multiple sclerosis", The Journal of Neuroscience (Feb. 11, 2004) 24(6), pp. 1521-1529.
Tsutsui et al., "RON-regulated innate immunity is protective in an animal model of multiple sclerosis", Annals of Neurology (Jun. 2005), vol. 57, No. 6, pp. 883-895.
Toft-Hansen et al., "Key Metalloproteinases are expressed by specific cell types in experimental autoimmune encephalomyelitis", The Journal of Immunology (2004) 173, pp. 5209-5218.
Valenca et al., "Lung morphometry and MMP-12 expression in rats treated with intraperitoneal nicotine", Exp. Toxic. Pathol. (2004) 55, pp. 393-400.
Valenca et al,. "Emphysema and metalloelastase expression in mouse lung induced by cigarette smoke", Toxicol. Pathol. (2004) 32, pp. 351-356.
Valentine et al,. "Characteristics of bovine alveolar macrophage elastase", Journal of Leukocyte Biology (1984) 35, pp. 449-457.
Vogel et al., "Activation of inflammatory mediators and potential role of Ah-receptor ligands in foam cell formation", Cardiovascular Toxicology (2004) 04, pp. 363-373.
Wagenaar et al,. "Gene expression profile and histopathology of experimental bronchopulmonary dysplasia induced by prolonged oxidative stress", Free Radical Biology & Medicine (2004) vol. 36, No. 6, pp. 782-801.
Vos et al,. "Matrix metalloproteinase-12 is expressed in phagocytotic macrophages in active multiple sclerosis lesions", Journal of Neuroimmunology (2003) 138, pp. 106-114.
Wang et al,. "Overexpression of human matrix metalloproteinase-12 enhances the development of inflammatory arthritis in transgenic rabbits", American Journal of Pathology (Oct. 2004) vol. 165, No. 4, pp. 1375-1383.
Warner et al., "Role of metalloelastase in a model of allergic lung responses induced by cockroach allergen", American Journal of Pathology (Dec. 2004) vol. 165, No. 6, pp. 1921-1930.
Wells et al,. "An adverse role for matrix metalloproteinase 12 after spinal cord injury in mice", The Journal of Neuroscience (Nov. 5, 2003), 23(31), pp. 10107-10115.
Wells et al,. "Matrix metalloproteinase (MMP)-12 expression has a negative impact on sensorimotor function following intracerebral haemorrhage in mice", European Journal of Neuroscience (2005) vol. 21, pp. 187-196.
Zhang et al,. "Polymorphisms in matrix metalloproteinase-1, 3, -9, and -12 genes in relation to subarachnoid hemorrhage", Stroke (2001) 32, pp. 2198-2202.
Zhou et al,. "Expression of matrix metalloproteinases and their tissue inhibitor during viral encephalitis", Journal of Virology (Apr. 2005) vol. 79, No. 8, pp. 4764-4773.
Zucker et al,. "Role of matrix metalloproteinases (MMPs) in colorectal cancer", Cancer and Metastasis Reviews (2004) 23, pp. 101-117.
Ling et al,. "Influence of N-acetylcysteine on the cytokines and matrix metalloproteinases in chronic obstructive pulmonary disease rat models", Chinese J Intern Med (Aug. 2004) vol. 43, No. 8, pp. 595-599.
International Search Report from International Application No. PCT/US09/35925 dated Jun. 5, 2009.
Galvez, B.G. et al., "Membrane Type 1-Matrix Metalloproteinase Is Activated During Migration of Human Endothelial Cells and Modulates Endothelial Motility and Matrix Remodeling", J. Biol. Chem., 276(40):37491-37500 (2001).
Itoh, "MT1-MMP: A Key Regulator of Cell Migration in Tissue", IUBMB Life, 58(10):589-596, Oct. 2006.
Shinoda et al., "A Novel Matrix Metalloproteinase Inhibitor, FYK-1388 Suppresses Tumor Growth, Metastatis and Angiogenesis by Human Fibrasarcoma Cell Line," International Journal of Oncology, vol. 22, No. 2, pp. 281-288, Feb. 1, 2003.
Albin et al., "Human alveolar macrophages secrete an inhibitor of metalloproteinase elastase", Am. Rev. Respir. Dis., (1987) 135(6):1281-5.
Andolfo et al., "Metalloproteases cleave the urokinase-type plasminogen activator receptor in the D1-D2 linker region and expose epitopes not present in the intact soluble receptor" Thromb Haemost, (2002) 88:298-306.
Anthony et al., "Matrix metalloproteinase expression in an experimentally-induced DTH model of multiple sclerosis in the rat CNS", Journal of Neuroimmunology, (1998) 87:62-72.
Arikan et al., "Induction of macrophage elastase (MMP-12) gene expression by statins" Journal of Cellular Physiology, (2005) 204:139-145.
Banda et al., "Interaction of mouse macrophage elastase with native and oxidized human α-proteinase inhibitor" J. Clin. Invest., (May 1987) vol. 79:1314-1317.
Barnes et al., "Characterization of T lymphocytes in chronic obstructive pulmonary disease" PLoS Medicine, (Oct. 2004) vol. 1(1):25-27.
Belaaouaj et al., "Matrix metalloproteinases cleave tissue factor pathway inhibitor", The Journal of Biological Chemistry, (Sep. 2000) vol. 275:35, pp. 27123-27128.
Belvisi et al., "The role of matrix metalloproteinases (MMPs) in the pathophysiology of chronic obstructive pulmonary disease (COPD): A therapeutic role for inhibitors of MMPs", Inflamm. Res. (2003) 52:95-100.
Bertini et al., "Conformational variability of matrix metalloproteinsaes: beyond a single 3D structure", PNAS (Apr. 2005) vol. 102:15, pp. 5334-5339.
Bister et al., "Matrilysins-1 and -2 (MMP-7 and -26) and Metalloelastase (MMP-12), unlike MMP-19, are up-regulated in necrotizing enterocolitis", J. Pediatr Gastroenterol Nutr. (Jan. 2005) 40(1):60-6.
Buchardt et al., "Solid phase combinatorial library of phosphinic peptides for discovery of matrix metalloproteinase inhibitors", J. Comb. Chem. (2000) 2:624-638.
Castrillo et al., "Liver X receptor-dependent repression of matrix metalloproteinse-9 expression in macrophages", The Journal of Biological Chemistry, (Mar. 2003) vol. 278, No. 12, pp. 10443-10449.
Cataldo et al., "Pathogenic role of matrix metalloproteases and their inhibitors in asthma and chronic obstructive pulmonary disease and therapeutic relevance of matrix metalloproteases inhibitors", Cellular and Molecular Biology, (2003) 49(6):875-884.
Chen, "MMP-12, an old enzyme plays a new role in the pathogenesis of rheumatoid arthritis?" American Journal of Pathology, (Oct. 2004) vol. 165, No. 4.
Chen et al., "Heat modulation of tropoelastin, fibrillin-1, and matrix metalloproteinase-12 in human skin in vivo", J. Invest Dermatol (2005) 124:70-78.
Ciccocioppo et al., "Matrix metalloproteinase pattern in celiac duodenal mucosa", Laboratory Investigation (2005) 85:397-407.
Cho et al., "MMP expression profiling in recurred stage IB lung cancer", Oncogene (2004) 23:845-851.
Cook et al., "Synthesis and evaluation of novel oxazoline MMP inhibitors", Bioorganic & Medicinal Chemistry Letters (2004) 14:4935-4939.
Curci et al., "Expression and localization of macrophage elastase (matrix metalloproteinase-12) in abdominal aortic aneurysms", (Dec. 1998) vol. 102:11, pp. 1900-1910.
D'Alessio et al,. "Matrix metalloproteinase 12-dependent cleavage of urokinase receptor in systemic sclerosis microvascular endothelial cells results in impaired angiogenesis", Arthritis & Rheumatism (Oct. 2004) vol. 50:10, pp. 3275-3285.
Demeule et al., "Matrix metalloproteinase inhibition by green tea catechins", Biochimica et Biophysica Acta (2000) 1478:51-60.
Dong-Hang et al., "Expression and purification of catalytic domain of human macrophage elastase for high-throughput inhibitor screening", Acta Pharmacol Sin (Feb. 2002) 23:2, pp. 143-151.
Edelstein et al., "Oxidative events cause degradation of apoB-100 but not of apo[a] and facilitate enzymatic cleavage of both proteins", Journal of Lipid Research (2001) vol. 42:1664-1670.

Feinberg et al., "Transforming growth factor-61 inhibits cytokine-mediated induction of human metalloelastase in macrophages", The Journal of Biological Chemistry (2000) vol. 275:33, pp. 25766-25773.

Fu et al., "Cloning, expression, purification, and characterization of rat MMP-12", Protein Expression and Purification (2001), vol. 21:268-274.

Gratchev et al,. "Interleukin-4 and dexamethasone counterregulate extracellular matrix remodeling and phagocytosis in type-2 macrophages", Scandinavian Journal of Immunology, No. 61:10-17, 2005.

Gingras et al., "Matrix proteinase inhibition by AE-941, a multifunctional antiangiogenic compound", Anticancer Research (2001) 21:145-156.

Hofmann et al. "Matrix metalloproteinase-12 expression correlates with local recurrence and metastatic disease in non-small cell lung cancer patients" Clinical Cancer Research (2005) 11:1086-1092.

Hou et al., "Matrix metalloproteinase-12 (MMP-12) in osteoclasts: new lesson on the involvement of MMPs in bone resorption", Bone (2004) vol. 34:37-4T.

Hughes et al., "Comparison of matrix metalloproteinase expression during wallerian degeneration in the central and peripheral nervous systems", Neuroscience (2002) vol. 113:2, pp. 273-28T.

Impola et al., "Differential expression of matrilysin-I (MMP-7), 92 kD gelatinase (MMP-9), and metalloelastase (MMP-12) in oral verrucous and squamous cell cancer" Journal of Pathology (2004), 202:14-22.

Impola et al., "Expression of matrix metalloproteinase (MMP)-7 and MMP-13 and loss of MMP-19 and p16 are associated with malignant progression in chronic wounds", British Journal of Dermatology (2005), 152:720-726.

Jensen et al., "Rational design of tropoelastin peptide-based inhibitors of metalloproteinases", Archives of Biochemistry and Biophysics (2003) 409:335-340.

Jones et al,. "Degradation of connective tissue matrices by macrophages", J. Exp. Med. (1980) vol. 152:1527-1536.

Joos et al., "The role of matrix metalloproteinase polymorphisms in the rate of decline of lung function", Human Molecular Genetics (2002) vol. 11, No. 5, pp. 569-576.

Jormsje et al., "Allele-specific regulation of matrix metalloproteinase-12 gene activity is associated with coronary artery luminal dimensions in diabetic patients with manifest coronary artery disease", Circ. Res, (2000) 86:998-1003.

Kaneko et al,. "Macrophage metalloelastase as a major factor for glomerular injury in anti-glomerular basement membrane nephritis", The Journal of Immunology (2003), 170:3377-3385.

Kangavari et al., "Smoking increases inflammation and metalloproteinase expression of human carotid atherosclerotic plaques", J. Cardiovasc Pharmacol Therapeut (2004) 9(4):291-298.

Kelly et al., "Gestational profile of matrix metalloproteinases in rat uterine artery", Molecular Human Reproduction (2003) vol. 9, No. 6, pp. 351-358.

Kim et al., "The Role of Angiostatin, vascular endothelial growth factor, matrix metalloproteinase-9 and 12 in the Angiogenesis of Hepatocellular Carcinoma", The Korean Journal of Hepatology (2004) vol. 10:(1), pp. 62-72.

Kleinerman et al., "Nitrogen dioxide exposure and alveolar macrophage elastase in hamsters", Am. Rev. Respir. Dis. (Feb. 1982) 125(2):203-7.

Lamblin et al., "Polymorphisms in the promoter regions of MMP-2, MMP-3, MMP-9 and MMP-12 genes as determinants of aneurysmal coronary artery disease", J. Am. Coll. Cardiol. (2002) 40:43-48.

Lappalainen et al., "Interleukin-1β causes pulmonary inflammation, emphysema, and airway remodeling in the adult murine lung", Am. J. Respir. Cell. Mol. Biol. (2005) vol. 32, pp. 311-318.

Larsen et al., "The expression of matrix metalloproteinase-12 by oligodendrocytes regulates their maturation and morphological differentiation", The Journal of Neuroscience (Sep. 2004) vol. 24(35), pp. 7597-7603.

Lavigne et al., "Human bronchial epithelial cells express and secrete MMP-12", Biochemical and Biophysical Research Communications (2004) 324:534-546.

Lavigne et al., "Cigarette smoke condensate induces MMP-12 gene expression in airway-like epithelia", Biochemical and Biophysical Research Communications (2005) 330:194-203.

Lian et al., "Lysosomal acid lipase deficiency causes respiratory inflammation and destruction in the lung", Am. J. Physiol. Lung Cell Mol. Physiol. (2004) 286:L801-L807.

Lian et al., "Overexpression of stat3C in pulmonary epithelium protects against hyperoxic lung injury", J. Immunol. (2005) 174:7250-7256.

Liang et al., "Macrophage metalloelastase accelerates the progression of atherosclerosis in transgenic rabbits", Circulation (2006) 113:1993-2001.

Lindsey et al., "Age-dependent changes in myocardial matrix metalloproteinase/tissue inhibitor of metalloproteinase profiles and fibroblast function", Cardiovascular Research (2005) 66:410-419.

* cited by examiner

Comment: this is the most encouraging result showing a dose-response. In our experience, this score is the most reliable parameter related to bronchial inflammation.

FIGURE 10A

| Name | HC-CDR1 | HC-CDR2 | HC-CDR3 | Aff. Mat. Cycle | IC50 | Kd (nM) | off rate |
|---|---|---|---|---|---|---|---|
| M08-H09 | D Y M M H | G Y I S G S G G Y T H Y A D S V K G | D I R G A Y S S G L F D Y | | .14 | .18 | 9.54E-03 |
| M63-B01 | W Y M M G | S I S P S G G Y T E Y A D S V K G | D I R G A Y S S G L F D Y | CDR1-2 | 0.7 | 0.17 | 8.80E-05 |
| M63-B11 | P Y M M H | G I G P S G G L I T Y A D S V K G | D I R G A Y S S G L F D Y | CDR1-2 | 0.7 | 0.12 | 5.88E-05 |
| M63-C07 | P Y M M S | G I G P S G G I T Y Y A D S V K G | D I R G A Y S S G L F D Y | CDR1-2 | 1 | 2.3 | 6.20E-04 |
| M63-G01 | W Y M M V | G I G P S G G D T E Y A D S V K G | D I R G A Y S S G L F D Y | CDR1-2 | 0.8 | 1.6 | 1.01E-03 |
| M065-H05 | Y Y G M G | Y I S P S G G E T E Y A D S V K G | D I R G A Y S S G L F D Y | CDR1-2 | 0.7 | 2.2 | 1.59E-03 |
| M067-B06 | W Y M M H | I I V S S G G T T I Y A D S V K G | D I R G A Y S S G L F D Y | CDR1-2 | 0.7 | 0.62 | 3.56E-04 |
| M067-F06 | W Y N M S | B I G P S G G T T E Y A D S V K G | D I R G A Y S S G L F D Y | CDR1-2 | 0.7 | 0.2 | 8.58E-05 |
| M069-C02 | Y Y N M H | G I G P S G G Q T E Y A D S V K G | D I R G A Y S S G L F D Y | CDR1-2 | 1.6 | 7 | 2.89E-03 |
| M071-A01 | E Y M M H | Y I G P S G G M T E Y A D S V K G | D I R G A Y S S G L F D Y | CDR1-2 | 0.3 | 1.1 | 3.30E-04 |
| M071-H03 | P Y W M H | H I G P S G G R T E Y A D S V K G | D I R G A Y S S G L F D Y | CDR1-2 | 0.2 | 1 | 8.21E-04 |
| M069-D10 | L Y H M H | M I G P S G G N T T I Y A D S V K G | D I R G A Y S S G L F D Y | CDR1-2 | 2.3 | 5.7 | 3.72E-03 |
| M071-D09 | P Y W M H | G I G P S G G Q T L I Y A D S V K G | D I R G A Y S S G L F D Y | CDR1-2 | 2.4 | 4.2 | 2.40E-03 |
| M065-E12 | W Y N M H | V I V P S G G T T S Y A D S V K G | D I R G A Y S S G L F D Y | CDR1-2 | 1.4 | 1.1 | 8.63E-04 |
| M088-H10 | W Y W M V | V I G P S G G E T Y T H Y A D S V K G | D I R G A Y S A S G L F D Y | CDR1-2 | 0.6 | | |
| M107-A12 | D Y N M H | Y I G P S G G Y T H Y A D S V K G | D I R G A Y S S G L F D Y | CDR3 | 2.34 | 1.8 | 1.31E-03 |
| M108-A02 | W Y W M H | H I S P S G G Q T H Y A D S I K G | D I R G A Y S S G L F D Y | CDR3 | 2.21 | ND | 4.63E-03 |
| M109-G11 | E Y N M H | M I G P S G G L T H Y A D S V K G | D I R G A Y S S G L F D Y | CDR3 | 6.22 | 7.5 | 3.90E-03 |
| M131-A06 | W Y Y M H | G I G P S G G M T H Y A D S V K G | D I R G P H Y S S G L F D Y | CDR3 | 0.299 | 0.18 | 1.91E-04 |
| M121-E07 | W Y G M H | G I G P S G G E T T H Y A D S V K G | D I V G P Y S A G L F D H | CDR3 | 0.006 | 0.197 | 1.41E-04 |
| M118-F11 | Y Y N M H | G I V P S G G L T H Y A D S V K G | D I R G V E L S A G L F D L | CDR3 | 0.914 | 1.17 | 4.13E-04 |
| M130-C12 | E Y M M H | G I V P S G G L T H Y A D S V K G | D I T G A Y S A G L F D Y | CDR3 | 0.688 | | |

HC-CDR1 AA change compared to parental
*HC-CDR2 AA change compared to parental*
HC-CDR3 <u>AA</u> change compared to parental

FIGURE 10A

| Mouse MMP12 | | | Estimate Kd improvement on huMMP-12 | Estimate off-rate improvement on mMMP-12 |
|---|---|---|---|---|
| IC50 | Kd (nM) | off rate | | |
| <10 | | 4.00E-03 | | |
| >10 | | 2.50E-03 | 100 | 1.5 |
| >10 | | 3.11E-03 | 150 | 1 |
| <10 | | 2.00E-03 | 8 | 2 |
| >10 | | 6.54E-03 | 10 | |
| ND | ND | ND | 8 | |
| <10 | | 3.05E-03 | 30 | 1 |
| <10 | | 2.50E-04 | 30 | 16 |
| ~10 | | 4.54E-03 | 2.5 | 1 |
| >10 | | 1.54E-02 | 18 | |
| <10 | ND | ND | 18 | 2 |
| | 3.4 | 1.69E-03 | 3 | 7 |
| | 1.3 | 6.06E-04 | 4.5 | 5 |
| | 1.7 | 8.49E-04 | 18 | 1 |
| >20 | 34.4 | 6.62E-03 | 23 (IC50) | 12 |
| | 0.9 | 3.29E-04 | 10 | 1.5 |
| | ND | 2.42E-03 | 10 | 7 |
| | 1 | 5.40E-04 | 2 | |
| | 7.27E-11 | 4.84E-05 | 100 | 82 |
| | 1.81E-10 | 1.15E-04 | 100 | 35 |
| | 7.27E-10 | 1.93E-04 | 20 | 20 |
| | | | 20 (IC50) | |

FIGURE 10B

METALLOPROTEINASE-12 SPECIFIC MONOCLONAL ANTIBODY

CROSS REFERENCE TO RELATED APPLICATIONS

This application claims priority to U.S. Application Ser. No. 61/033,348, filed on Mar. 3, 2008 and U.S. Application Ser. No. 61/127,830, filed on May 14, 2008. The disclosures of the prior applications are considered part of (and are incorporated by reference in) the disclosure of this application.

BACKGROUND

Matrix Metalloproteinases (MMPs) are a family of zinc metalloendopeptidases secreted by cells, and are responsible for much of the turnover of matrix components. The MMP family consists of at least 26 members, all of which share a common catalytic core with a zinc molecule in the active site.

SUMMARY

This disclosure relates, inter alia, to proteins that bind MMP-12, herein referred to as "MMP-12 binding proteins," and methods of identifying and using such proteins. These proteins include antibodies and antibody fragments (e.g., primate antibodies and Fabs, especially human antibodies and Fabs) that bind to MMP-12 (e.g., human MMP-12). In some embodiments, these proteins include antibodies and antibody fragments (e.g., primate antibodies and Fabs, especially human antibodies and Fabs) that inhibit MMP-12 (e.g., human MMP-12) (e.g., inhibit the catalytic activity of MMP-12). The MMP-12 binding proteins can be used in the treatment of diseases, particularly human disease, such as cancer, inflammation, cardiovascular disease, aneurysm, wound healing, aging, and nerve damage in which excess or inappropriate activity of MMP-12 features. In many cases, the proteins have tolerable low or no toxicity.

In some aspects, the disclosure relates to proteins (e.g., antibodies, peptides and Kunitz domain proteins) that bind MMP-12, in particular, proteins (e.g., antibodies (e.g., human antibodies), peptides and Kunitz domain proteins) that bind and inhibit MMP-12.

In one embodiment, the disclosure provides a human antibody that binds to human MMP-12. In one embodiment, the human antibody is an inhibitor of the catalytic activity of MMP-12. The antibody can be, e.g., an IgG1, IgG2, IgG3, IgG4, Fab, Fab2', scFv, minibody, scFv::Fc fusion, Fab::HSA fusion, HSA::Fab fusion, Fab::HSA::Fab fusion, or other molecule that comprises the antigen combining site of one of the antibodies herein listed. In one embodiment, the antibody is used to guide a nano-particle or toxin to a cell expressing MMP-12 on the cell surface. In one embodiment, the antibody causes effector functions (CDC or ADCC) to kill the cell which expresses MMP-12.

In some embodiments, the VH and VL regions of the binding proteins (e.g., Fabs) can be provided as IgG, Fab, Fab2, Fab2', scFv, PEGylated Fab, PEGylated scFv, PEGylated Fab2, VH::CH1::HSA+LC, HSA::VH::CH1+LC, LC:: HSA+VH::CH1, HSA::LC+VH::CH1, or other appropriate construct.

In another embodiment, the binding protein comprises a Kunitz domain protein or modified version (e.g., HSA fusion) or peptide-based MMP-12 binding protein that can inhibit MMP-12 activity.

In one aspect, the disclosure features a protein (e.g., an isolated protein) that binds to MMP-12 (e.g., human MMP-12) and includes at least one immunoglobulin variable region. For example, the protein includes a heavy chain (HC) immunoglobulin variable domain sequence and a light chain (LC) immunoglobulin variable domain sequence. In one embodiment, the protein binds to and inhibits MMP-12 (e.g., inhibits MMP-12 catalytic activity), e.g., human MMP-12.

In some embodiments, the protein binds to human MMP-12 specifically, and not to MMP-12 from another species (e.g., the protein does not bind to MMP-12 from another species with greater than background levels of binding).

In some embodiments, the protein binds MMP-12 specifically, and not to another matrix metalloproteinase (e.g., the protein does not bind to any other matrix metalloproteinase with greater than background levels of binding).

Such binding proteins can be conjugated to a drug (e.g., to form a MMP-12 binding protein-drug conjugate) and used therapeutically. This disclosure relates, in part, to MMP-12 binding protein-drug conjugates, the preparation of these conjugates, and uses thereof. The conjugates can be used, e.g., in the treatment of disorders, e.g., for the treatment of cancer, inflammation, cardiovascular disease, aneurysm, wound healing, aging, or nerve damage. Targeting (e.g., a killing) of the MMP-12 expressing cells and/or tumors, e.g., with high affinity binding protein-drug conjugates can be a potent therapy in the treatment of diseases, e.g., cancer, inflammation, cardiovascular disease, aneurysm, wound healing, aging, and nerve damage.

The protein can include one or more of the following characteristics: (a) a human CDR or human framework region; (b) the HC immunoglobulin variable domain sequence comprises one or more (e.g., 1, 2, or 3) CDRs that are at least 85, 88, 90, 91, 92, 93, 94, 95, 96, 97, 98, 99, or 100% identical to a CDR of a HC variable domain described herein; (c) the LC immunoglobulin variable domain sequence comprises one or more (e.g., 1, 2, or 3) CDRs that are at least 85, 88, 90, 91, 92, 93, 94, 95, 96, 97, 98, 99, or 100% identical to a CDR of a LC variable domain described herein; (d) the LC immunoglobulin variable domain sequence is at least 85, 88, 90, 91, 92, 93, 94, 95, 96, 97, 98, 99, or 100% identical to a LC variable domain described herein; (e) the HC immunoglobulin variable domain sequence is at least 85, 88, 90, 91, 92, 93, 94, 95, 96, 97, 98, 99, or 100% identical to a HC variable domain described herein; (f) the protein binds an epitope bound by a protein described herein, or an epitope that overlaps with such epitope; and (g) a primate CDR or primate framework region.

The protein can bind to MMP-12, e.g., human MMP-12, with a binding affinity of at least $10^5$, $10^6$, $10^7$, $10^8$, $10^9$, $10^{10}$ and $10^{11}$ $M^{-1}$. In one embodiment, the protein binds to MMP-12 with a $K_{off}$ slower than $1\times10^{-3}$, $5\times10^{-4}$ $s^{-1}$, or $1\times10^{-4}$ $s^{-1}$. In one embodiment, the protein binds to MMP-12 with a $K_{on}$ faster than $1\times10^2$, $1\times10^3$, or $5\times10^3$ $M^{-1}$ $s^{-1}$. In one embodiment, the protein inhibits human MMP-12 activity, e.g., with a Ki of less than $10^{-5}$, $10^{-6}$, $10^{-7}$, $10^{-8}$, $10^{-9}$, and $10^{-10}$ M. The protein can have, for example, an $IC_{50}$ of less than 100 nM, 10 nM or 1 nM. In some embodiments, the protein has an $IC_{50}$ of about 1.8 nM. The affinity of the protein for MMP-12 can be characterized by a $K_D$ of less than 100 nm, less than 10 nM, or about 3 nM (e.g., 3.1 nM), about 5 nM (e.g., 5 nM), about 6 nm (e.g., 5.9 nM), about 7 nM (e.g., 7.1 nM), or about 10 nM (e.g., 9.6 nM).

In some embodiments, the protein has a $K_D$<200 nM.

In some embodiments, the protein has a t1/2 of at least about 10 minutes (e.g., 11 minutes), at least about 20 minutes (e.g., 18 minutes), at least about 25 minutes (e.g., 25 minutes), at least about 35 minutes (e.g., 33 minutes), or at least about 60 minutes (e.g., 57 minutes).

In one embodiment, the protein binds the catalytic domain of human MMP-12, e.g., the protein contacts residues in or near the active site of MMP-12.

In some embodiments, the protein does not contact residues in or near the active site of MMP-12 but instead binds elsewhere on MMP-12 and causes a steric change in MMP-12 that affects (e.g., inhibits) its activity.

In a preferred embodiment, the protein is a human antibody having the light and heavy chains of antibodies picked from the list comprising M0134-A02, M134-A05, M134-A07, M134-A09, M134-A10, M134-A11, M0134-B01, M134-B04, M0134-B08, M0134-B11, M0134-C01, M0134-C02, M0134-C06, M0134-C09, M0134-C10, M0134-C11, M0134-C12, M0134-D02, M0134-DO3, M0134-E04, M0134-E07, M0134-E08, M134-E11, M0134-F01, M0134-F05, M0134-G02, M0134-G04, M0134-G07, M0135-A03, M0135-A05, M0135-A06, M0135-A07, M0135-B02, M0135-B08, M0135-C01, M0135-C11, M0135-E03, M0135-F03, M0135-F11, M0135-G02, M0135-G03, M0135-G07, M0135-G11, M0135-H03, M0135-H10, M0105-C05, M0105-E11, M0105-F08, M0107-A12, M0108-A02, M0109-G11, M0110-G05, M0129-B11, M0130-A01, M0130-C12, M0130-F06, M0130-H04, M0131-A06, M0131-D03, M0132-A04, M0133-B08, M0133-E05, M0121-E07, M0118-F11, M0125-G07, M0124-E07, M0119-D01, M0119-A02, M0122-C06, M0123-G07, M0063-A02, M0063-A04, M0063-B01, M0063-B11, M0063-C07, M0063-G01, M0065-E12, M0065-G03, M0065-H05, M0067-A02, M0067-B06, M0067-B09, M0067-C10, M0067-F02, M0067-F06, M0069-A04, M0069-A11, M0069-C02, M0069-D10, M0069-G07, M0071-A01, M0071-B07, M0071-D05, M0071-D09, M0071-H03, M0071-H06, M0087-F09, M0088-F07, M0088-G10, M0088-H10, M0089-C01, M0089-F05, M0089-B07, M0089-H11, M0034-C04, M0039-F01, M0041-B05, M0041-G01, M0042-B06, M0006-B10, M0007-H06, M0008-H09, M0009-H08, M001-H11, M0015-F02, M0016-D01, M0013-D11, M0013-G12, M0013-H06, M0014-C09, M0014-G11, M0016-A11, M0016-H05, M0019-C05, M0020-B01, M0022-C07, M0025-D04 and M0027-E11. In a preferred embodiment, the protein is a human antibody having its heavy chain picked from the list comprising M0134-A02, M134-A05, M134-A07, M134-A09, M134-A10, M134-A11, M0134-B01, M134-B04, M0134-B08, M0134-B11, M0134-C01, M0134-C02, M0134-C06, M0134-C09, M0134-C10, M0134-C11, M0134-C12, M0134-D02, M0134-DO3, M0134-E04, M0134-E07, M0134-E08, M134-E11, M0134-F01, M0134-F05, M0134-G02, M0134-G04, M0134-G07, M0135-A03, M0135-A05, M0135-A06, M0135-A07, M0135-B02, M0135-B08, M0135-C01, M0135-C11, M0135-E03, M0135-F03, M0135-F11, M0135-G02, M0135-G03, M0135-G07, M0135-G11, M0135-H03, M0135-H10, M0105-C05, M0105-E11, M0105-F08, M0107-A12, M0108-A02, M0109-G11, M0110-G05, M0129-B11, M0130-A01, M0130-C12, M0130-F06, M0130-H04, M0131-A06, M0131-D03, M0132-A04, M0133-B08, M0133-E05, M0121-E07, M0118-F11, M0125-G07, M0124-E07, M0119-D01, M0119-A02, M0122-C06, M0123-G07, M0063-A02, M0063-A04, M0063-B01, M0063-B11, M0063-C07, M0063-G01, M0065-E12, M0065-G03, M0065-H05, M0067-A02, M0067-B06, M0067-B09, M0067-C10, M0067-F02, M0067-F06, M0069-A04, M0069-A11, M0069-C02, M0069-D10, M0069-G07, M0071-A01, M0071-B07, M0071-D05, M0071-D09, M0071-H03, M0071-H06, M0087-F09, M0088-F07, M0088-G10, M0088-H10, M0089-C01, M0089-F05, M0089-B07, M0089-H11, M0034-C04, M0039-F01, M0041-B05, M0041-G01, M0042-B06, M0006-B10, M0007-H06, M0008-H09, M0009-H08, M001-H11, M0015-F02, M0016-D01, M0013-D11, M0013-G12, M0013-H06, M0014-C09, M0014-G11, M0016-A11, M0016-H05, M0019-C05, M0020-B01, M0022-C07, M0025-D04 and M0027-E11. In a preferred embodiment, the protein is a human antibody having its light chain picked from the list comprising M0134-A02, M134-A05, M134-A07, M134-A09, M134-A10, M134-A11, M0134-B0, M134-B04, M0134-B08, M0134-B11, M0134-C01, M0134-C02, M0134-C06, M0134-C09, M0134-C10, M0134-C11, M0134-C12, M0134-D02, M0134-DO3, M0134-E04, M0134-E07, M0134-E08, M0134-E11, M0134-F01, M0134-F05, M0134-G02, M0134-G04, M0134-G07, M0135-A03, M0135-A05, M0135-A06, M0135-A07, M0135-B02, M0135-B08, M0135-C0, M0135-C11, M0135-E03, M0135-F03, M0135-F11, M0135-G02, M0135-G03, M0135-G07, M0135-G11, M0135-H03, M0135-H10, M0105-C05, M0105-E11, M0105-F08, M0107-A12, M0108-A02, M0109-G11, M0110-G05, M0129-B11, M0130-A01, M0130-C12, M0130-F06, M0130-H04, M0131-A06, M0131-D03, M0132-A04, M0133-B08, M0133-E05, M0121-E07, M0118-F11, M0125-G07, M0124-E07, M0119-D0, M0119-A02, M0122-C06, M0123-G07, M0063-A02, M0063-A04, M0063-B01, M0063-B11, M0063-C07, M0063-G01, M0065-E12, M0065-G03, M0065-H05, M0067-A02, M0067-B06, M0067-B09, M0067-C10, M0067-F02, M0067-F06, M0069-A04, M0069-A11, M0069-C02, M0069-D10, M0069-G07, M0071-A01, M0071-B07, M0071-D05, M0071-D09, M0071-H03, M0071-H06, M0087-F09, M0088-F07, M0088-G10, M0088-H10, M0089-C01, M0089-F05, M0089-B07, M0089-H11, M0034-C04, M0039-F01, M0041-B05, M0041-G01, M0042-B06, M0006-B10, M0007-H06, M0008-H09, M0009-H08, M0011-H11, M0015-F02, M0016-D0, M0013-D11, M0013-G12, M0013-H06, M0014-C09, M0014-G11, M0016-A11, M0016-H05, M0019-C05, M0020-B01, M0022-C07, M0025-D04 and M0027-E11. In a preferred embodiment, the protein is a human antibody having one or more (e.g., 1, 2, or 3) heavy chain CDRs picked from the corresponding CDRs of the list of heavy chains comprising M0134-A02, M134-A05, M134-A07, M134-A09, M134-A10, M134-A11, M0134-B01, M134-B04, M0134-B08, M0134-B11, M0134-C01, M0134-C02, M0134-C06, M0134-C09, M0134-C10, M0134-C11, M0134-C12, M0134-D02, M0134-DO3, M0134-E04, M0134-E07, M0134-E08, M134-E11, M0134-F11, M0134-F05, M0134-G02, M0134-G04, M0134-G07, M0135-A03, M0135-A05, M0135-A06, M0135-A07, M0135-B02, M0135-B08, M0135-C01, M0135-C11, M0135-E03, M0135-F03, M0135-F11, M0135-G02, M0135-G03, M0135-G07, M0135-G11, M0135-H03, M0135-H10, M0105-C05, M0105-E11, M0105-F08, M0107-A12, M0108-A02, M0109-G11, M0110-G05, M0129-B11, M0130-A01, M0130-C12, M0130-F06, M0130-H04, M0131-A06, M0131-D03, M0132-A04, M0133-B08, M0133-E05, M0121-E07, M0118-F11, M0125-G07, M0124-E07, M0119-D01, M0119-A02, M0122-C06, M0123-G07, M0063-A02, M0063-A04, M0063-B01, M0063-B11, M0063-C07, M0063-G01, M0065-E12, M0065-G03, M0065-H05, M0067-A02, M0067-B06, M0067-B09, M0067-C10, M0067-F02, M0067-F06, M0069-A04, M0069-A11, M0069-C02, M0069-D10, M0069-G07, M0071-A01, M0071-B07, M0071-D05, M0071-D09, M0071-H03, M0071-H06, M0087-F09, M0088-F07, M0088-G10, M0088-H10, M0089-C01, M0089-F05, M0089-B07, M0089-H11, M0034-C04, M0039-F01, M0041-B05, M0041-G01, M0042-B06, M0006-B10, M0007-H06, M0008-H09, M0009-H08, M0011-H11, M0015-F02, M0016-D01, M0013-D11, M0013-G12, M0013-H06, M0014-C09, M0014-G11, M0016-A11, M0016-H05, M0019-C05, M0020-B01, M0022-C07, M0025-D04 and M0027-E11. In a preferred embodiment, the protein is a human antibody having one or more (e.g., 1, 2, or 3) light chain CDRs picked from the corresponding CDRs of the list of light chains comprising M0134-A02, M134-A05, M134-A07, M134-A09, M134-A10, M134-A11, M0134-B01, M134-B04, M0134-B08, M0134-B11, M0134-C01, M0134-C02, M0134-C06, M0134-C09, M0134-C10, M0134-C11, M0134-C12, M0134-D02, M0134-DO3, M0134-E04, M0134-E07, M0134-E08, M134-E11, M0134-F01, M0134-F05, M0134-G02, M0134-G04, M0134-G07, M0135-A03, M0135-A05, M0135-A06, M0135-A07, M0135-B02, M0135-B08, M0135-C01, M0135-C11, M0135-E03, M0135-F03, M0135-F11, M0135-G02, M0135-G03, M0135-G07, M0135-G11, M0135-H03, M0135-H10, M0105-C05, M0105-E11, M0105-F08, M0107-A12, M0108-A02, M0109-G11, M0110-G05, M0129-B11, M0130-A01, M0130-C12, M0130-F06, M0130-H04, M0131-A06, M0131-D03, M0132-A04, M0133-B08, M0133-E05, M0121-E07, M0118-F11, M0125-G07, M0124-E07, M0119-D01, M0119-A02, M0122-C06, M0123-G07, M0063-A02, M0063-A04, M0063-B01, M0063-B11, M0063-C07, M0063-G01, M0065-E12, M0065-G03, M0065-H05, M0067-A02, M0067-B06, M0067-B09, M0067-C10, M0067-F02, M0067-F06, M0069-A04, M0069-A11, M0069-C02, M0069-D10, M0069-G07, M0071-A01, M0071-B07, M0071-D05, M0071-D09, M0071-H03, M0071-H06, M0087-F09, M0088-F07, M0088-G10, M0088-H10, M0089-C01, M0089-F05, M0089-B07, M0089-H11, M0034-C04, M0039-F01, M0041-B05, M0041-G01, M0042-B06, M0006-B10, M0007-H06, M0008-H09, M0009-H08, M0011-H11, M0015-F02, M0016-D01, M0013-D11, M0013-G12, M0013-H06, M0014-C09, M0014-G11, M0016-A11, M0016-H05, M0019-C05, M0020-B01, M0022-C07, M0025-D04 and M0027-E11.

In a more preferred embodiment, the protein is a human antibody having the light and heavy chains of antibodies from M0008-H09, M0131-A06 or M0121-E07. In another preferred embodiment, the protein is a human antibody having its heavy chain from M0008-H09, M0131-A06 or M0121-E07. In yet another preferred embodiment, the protein is a human antibody having its light chain from M0008-H09, M0131-A06 or M0121-E07. In an even more preferred embodiment, the protein is a human antibody having one or more (e.g., 1, 2, or 3) heavy chain CDRs from the corresponding CDRs of the heavy chain comprising M0008-H09, M0131-A06 or M0121-E07. In another even more preferred embodiment, the protein is a human antibody having one or more (e.g., 1, 2, or 3) light chain CDRs from the corresponding CDRs of the light chains comprising M0008-H09, M0131-A06 or M0121-E07.

In a more preferred embodiment, the protein is a human antibody having the light and heavy chains of antibody DX-2712 (also referred to as M0131-A06-GA-S). In another preferred embodiment, the protein is a human antibody having its heavy chain from antibody DX-2712. In yet another preferred embodiment, the protein is a human antibody having its light chain from antibody DX-2712. In an even more preferred embodiment, the protein is a human antibody having one or more (e.g., 1, 2, or 3) heavy chain CDRs from the corresponding CDRs of the heavy chain from antibody DX-2712. In another even more preferred embodiment, the protein is a human antibody having one or more (e.g., 1, 2, or 3) light chain CDRs from the corresponding CDRs of the light chains from antibody DX-2712.

In another embodiment, the protein is a human antibody having the light and heavy chains of a mutant or variant of DX-2712, e.g., a mutant or variant described herein. In another preferred embodiment, the protein is a human antibody having its heavy chain from a mutant or variant of DX-2712, e.g., a mutant or variant described herein. In yet another preferred embodiment, the protein is a human antibody having its light chain from a variant of DX-2712, e.g., a mutant or variant described herein. In an even more preferred embodiment, the protein is a human antibody having one or more (e.g., 1, 2, or 3) heavy chain CDRs from the corresponding CDRs of the heavy chain from a mutant or variant of DX-2712, e.g., a mutant or variant described herein. In another even more preferred embodiment, the protein is a human antibody having one or more (e.g., 1, 2, or 3) light chain CDRs from the corresponding CDRs of the light chains from a mutant or variant of DX-2712, e.g., a mutant or variant described herein.

In a more preferred embodiment, the protein is a human antibody having the light and heavy chains of antibody 539B-X0041-D02. In another preferred embodiment, the protein is a human antibody having its heavy chain from antibody 539B-X0041-D02. In yet another preferred embodiment, the protein is a human antibody having its light chain from antibody 539B-X0041-D02. In an even more preferred embodiment, the protein is a human antibody having one or more (e.g., 1, 2, or 3) heavy chain CDRs from the corresponding CDRs of the heavy chain from antibody 539B-X0041-D02. In another even more preferred embodiment, the protein is a human antibody having one or more (e.g., 1, 2, or 3) light chain CDRs from the corresponding CDRs of the light chains from antibody 539B-X0041-D02.

In another embodiment, the protein is a human antibody having the light and heavy chains of a variant of 539B-X0041-D02, e.g., a variant described herein. In another preferred embodiment, the protein is a human antibody having its heavy chain from a variant of 539B-X0041-D02, e.g., a variant described herein. In yet another preferred embodiment, the protein is a human antibody having its light chain from a variant of 539B-X0041-D02, e.g., a variant described herein. In an even more preferred embodiment, the protein is a human antibody having one or more (e.g., 1, 2, or 3) heavy chain CDRs from the corresponding CDRs of the heavy chain from a variant of 539B-X0041-D02, e.g., a variant described herein. In another even more preferred embodiment, the protein is a human antibody having one or more (e.g., 1, 2, or 3) light chain CDRs from the corresponding CDRs of the light chains from a variant of 539B-X0041-D02, e.g., a variant described herein.

In one embodiment, the HC and LC variable domain sequences are components of the same polypeptide chain. In another, the HC and LC variable domain sequences are components of different polypeptide chains. For example, the protein is an IgG, e.g., IgG1, IgG2, IgG3, or IgG4. The protein can be a soluble Fab (sFab). In other implementations the protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::

CH1::HSA+LC, HSA::VH::CH1+LC, LC::HSA+VH::CH1, HSA::LC+VH::CH1, or other appropriate construction.

In one embodiment, the protein is a human or humanized antibody or is non-immunogenic in a human. For example, the protein includes one or more human antibody framework regions, e.g., all human framework regions. In one embodiment, the protein includes a human Fc domain, or an Fc domain that is at least 95, 96, 97, 98, or 99% identical to a human Fc domain.

In one embodiment, the protein is a primate or primatized antibody or is non-immunogenic in a human. For example, the protein includes one or more primate antibody framework regions, e.g., all primate framework regions. In one embodiment, the protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In certain embodiments, the protein includes no sequences from mice or rabbits (e.g., is not a murine or rabbit antibody).

In one embodiment, protein is physically associated with a nanoparticle, and can be used to guide a nanoparticle to a cell expressing MMP-12 on the cell surface. In one embodiment, the protein causes effector cells (CDC or ADCC) to kill a cell which expresses MMP-12.

In another aspect, the disclosure features a MMP-12 binding protein that is a competitive inhibitor of MMP-12. In some embodiments, the binding protein competes with an MMP-12 substrate (e.g., lung extracellular matrix, elastin, gelatin, fibronectin, apo[a], apoB-100, collagen, osteonectin, TFPI, alpha 1-protease inhibitor, uPAR and CD 14), e.g., binds to the same epitope as the substrate, e.g., and prevents substrate binding.

In some aspects, the disclosure features a method of inhibiting an interaction between MMP-12 and an MMP-12 substrate (e.g., lung extracellular matrix, elastin, gelatin, fibronectin, apo[a], apoB-100, collagen, osteonectin, TFPI, alpha 1-protease inhibitor, uPAR and CD14). The method includes contacting an MMP-12 binding protein described herein with MMP-12 (e.g., in vitro or in vivo), wherein the binding protein binds to MMP-12 and thereby prevents the binding of an MMP-12 substrate to MMP-12. In some embodiments, the binding protein binds to the same epitope on MMP-12 as the substrate, e.g., the binding protein is a competitive inhibitor. In some embodiments, the binding protein does not bind the same epitope as the substrate but causes a steric change in MMP-12 that decreases or inhibits the ability of the substrate to bind.

In one aspect, the disclosure features a MMP-12 binding protein-drug conjugate that includes a MMP-12 binding protein and a drug.

In one embodiment, the binding protein comprises at least one immunoglobulin variable region, and/or the protein binds to and/or inhibits MMP-12, e.g., inhibits MMP-12 catalytic activity.

In one embodiment, the drug is a cytotoxic or cytostatic agent. The cytotoxic agent can be, e.g., selected from the group consisting of an auristatin, a DNA minor groove binding agent, a DNA minor groove alkylating agent, an enediyne, a lexitropsin, a duocarmycin, a taxane, a puromycin, a dolastatin, a podophyllotoxin, a baccatin derivative, a cryptophysin, a combretatstatin, a maytansinoid, and a vinca alkaloid. In one embodiment, the cytotoxic agent is an auristatin and, e.g., the auristatin is selected from AFP, MMAF, MMAE, AEB, AEVB and auristatin E. In one embodiment, the auristatin is AFP or MMAF. In another embodiment, the cytotoxic agent is a maytansinoid and, e.g., the maytansinoid is selected from a maytansinol, maytansine, DM1, DM2, DM3 and DM4. In one embodiment, the maytansinoid is DM1. In another embodiment, the cytotoxic agent is selected from paclitaxel, docetaxel, CC-1065, SN-38, topotecan, morpholino-doxorubicin, rhizoxin, cyanomorpholino-doxorubicin, dolastatin-10, echinomycin, combretatstatin, calicheamicin, and netropsin. In one embodiment, the cytotoxin is an auristatin, a maytansinoid, or calicheamicin.

In one embodiment, the cytotoxic agent is an antitubulin agent and, e.g., the antitubulin agent is selected from AFP, MMAP, MMAE, AEB, AEVB, auristatin E, vincristine, vinblastine, vindesine, vinorelbine, VP-16, camptothecin, paclitaxel, docetaxel, epothilone A, epothilone B, nocodazole, colchicines, colcimid, estramustine, cemadotin, discodermolide, maytansinol, maytansine, DM1, DM2, DM3, DM4 and eleutherobin.

In one embodiment, the MMP-12 binding protein (e.g., antibody) is conjugated to the drug (e.g., cytotoxic agent) via a linker. In one embodiment, the linker is cleavable under intracellular conditions, e.g., the cleavable linker is a peptide linker cleavable by an intracellular protease. In one embodiment, the linker is a peptide linker, e.g., a dipeptide linker, e.g., a val-cit linker or a phe-lys linker. In one embodiment, the cleavable linker is hydrolyzable at a pH of less than 5.5, e.g., the hydrolyzable linker is a hydrazone linker. In another embodiment, the cleavable linker is a disulfide linker.

A binding protein described herein can be provided as a pharmaceutical composition, e.g., including a pharmaceutically acceptable carrier. The composition can be at least 10, 20, 30, 50, 75, 85, 90, 95, 98, 99, or 99.9% free of other protein species. In some embodiments, the binding protein can be produced under GMP (good manufacturing practices). In some embodiments, the binding protein is provided in pharmaceutically acceptable carriers, e.g., suitable buffers or excipients.

The dose of a binding protein (e.g., a pharmaceutical composition containing a binding protein described herein) is sufficient to block about 20%, about 30%, about 40%, about 50%, about 60%, about 70%, about 80%, about 85%, about 90%, about 95%, about 99%, or about 100% of the activity of MMP-12 in the patient, e.g., at the site of disease. Depending on the disease, this may require a dose, e.g., of between about 0.01 mg/Kg to about 100 mg/Kg, e.g., between about 0.1 and about 10 mg/Kg. For example, the dose can be a dose of about 0.1, about 1, about 3, about 6, or about 10 mg/Kg. For example, for an IgG having a molecular mass of 150,000 g/mole (2 binding sites), these doses correspond to approximately 18 nM, 180 nM, 540 nM, 1.08 microM, and 1.8 microM, respectively, of binding sites for a 5 L blood volume. Medicine being partly an art, the optimal dose will be established by clinical trials, but will most likely lie in this range.

In another aspect, the disclosure features a method of detecting an MMP-12 in a sample, e.g., a sample from a patient (e.g., tissue biopsy or blood sample). The method includes: contacting the sample with an MMP-12 binding protein; and detecting an interaction between the protein and the MMP-12, if present. In some embodiments, the protein includes a detectable label. An MMP-12 binding protein can be used to detect MMP-12 in a subject. The method includes: administering an MMP-12 binding protein to a subject; and detecting the protein in the subject. In some embodiments, the protein further includes a detectable label. For example, the detecting comprises imaging the subject. For example, MMP-12 activity can be a marker of inflammation and/or disease progression in subjects with, or suspected of having, an inflammatory disorder of the lung such as, e.g., emphysema and chronic obstructive pulmonary disease (COPD).

In another aspect, the disclosure features a method of modulating MMP-12 activity. The method includes: contacting an MMP-12 with an MMP-12 binding protein (e.g., in a human subject), thereby modulating MMP-12 activity. In some embodiments, the binding protein inhibits MMP-12 activity (e.g., inhibits MMP-12 catalytic activity).

In another aspect, the disclosure features a method of treating cancer (e.g., metastatic cancer) (e.g., in a subject that has cancer or is suspected of having cancer). The method includes: administering, to a subject, an MMP-12 binding protein in an amount sufficient to treat a cancer in the subject. For example, the cancer is head and neck cancer, oral cavity cancer, laryngeal cancer, chondrosarcoma, breast cancer (which may be estrogen receptor positive (ER+), estrogen receptor negative (ER−), Her2 positive (Her2+), Her2 negative (Her2−), or a combination thereof, e.g., ER+/Her2+, ER+/Her2−, ER−/Her2+, or ER−/Her2−), laryngeal cancer, ovarian cancer, lung cancer (e.g., non-small cell lung cancer), prostate cancer, colon cancer, colorectal cancer, heptacellular cancer, testicular carcinoma, melanoma, or a brain tumor (e.g., astrocytomas, glioblastomas, gliomas).

MMP-12 binding proteins can be useful for modulating metastatic activity in a subject (e.g., in a subject that has a metastatic cancer or is suspected of having a metastatic cancer). The protein can be administered, to the subject, in an amount effective to modulate metastatic activity. For example, the protein inhibits one or more of: tumor growth, tumor embolism, tumor mobility, tumor invasiveness, and cancer cell proliferation.

The methods disclosed herein relating to the treatment cancer (e.g., treating cancer and/or modulation of metastatic activity) can further include providing (e.g., administering) to the subject a second therapy that is an anti-cancer therapy, e.g., administration of a chemotherapeutic, e.g., an agent that antagonizes signaling through a VEGF pathway, e.g., bevacizumab (AVASTIN®). In one embodiment, the second therapy includes administering 5-FU, leucovorin, and/or irinotecan. In one embodiment, the second therapy includes administering a Tie1 inhibitor (e.g., an anti-Tie1 antibody). In one embodiment, the second therapy is an inhibitor of plasmin (e.g., a kunitz domain disclosed in U.S. Pat. No. 6,010,880, such as a protein or polypeptide comprising the amino acid sequence

```
MHSFCAFKAETGPCRARFDRWFFNIFTRQCEEFI (SEQ ID NO: 1)
YGGCEGNQNRFESLEECKKMCTRD.
```

In another aspect, the disclosure features a method of treating inflammation (e.g., in a subject that has inflammation or is suspected of having inflammation, e.g., inflammation associated with an inflammatory disease) or an inflammatory disease (e.g., in a subject that has an inflammatory disease or is suspected of having an inflammatory disease). Inflammatory diseases that can be treated include, e.g., atherosclerosis, multiple sclerosis, systemic sclerosis, nephritis, encephalomyelitis (e.g., experimental autoimmune encephalomyelitis), rheumatoid arthritis, encephalitis (e.g., viral encephalitis), colitis (e.g., enterocolitis) and neuroinflammatory disease. The method includes: administering, to a subject, an MMP-12 binding protein in an amount sufficient to treat inflammation in the subject. The method can further include providing to the subject a second therapy that is an inflammation therapy. For example, particularly for rheumatoid arthritis, the second therapy comprises administering one or more of the following agents: aspirin, naproxen, ibuprofen, etodolac, cortisone (corticosteroids), antacids, sucralfate, proton-pump inhibitors, misoprostol, gold (e.g., gold salts, gold thioglucose, gold thiomalate, oral gold), methotrexate, sulfasalazine, D-penicillamine, azathioprine, cyclophosphamide, chlorambucil, cyclosporine, leflunomide, etanercept, infliximab, anakinra, adalimumab, and/or hydroxychloroquine.

In another aspect, the disclosure features a method of treating a disease associated with inflammation of the lung (e.g., in a subject that has inflammation of the lung or is suspected of having inflammation of the lung) or a disease associated with inflammation of the lung (e.g., in a subject that has a disease associated with inflammation of the lung or is suspected of having a disease associated with inflammation of the lung). Diseases associated with inflammation of the lung include, e.g., emphysema, chronic obstructive pulmonary disease (COPD), asthma, and lung injury in hyperoxia. The method includes: administering, to a subject, an MMP-12 binding protein in an amount sufficient to treat inflammation of the lung in the subject. The method can further include providing to the subject a second therapy that is an inflammation therapy.

In another aspect, the disclosure features a method of treating cardiovascular disease (e.g., in a subject that has cardiovascular disease or is suspected of having cardiovascular disease). The method includes: administering, to a subject, an MMP-12 binding protein in an amount sufficient to treat cardiovascular disease in the subject. The method can further include providing to the subject a second therapy that is a therapy for cardiovascular disease.

In another aspect, the disclosure features a method of treating a stroke or aneurysm (e.g., in a subject that has a stroke or aneurysm or is suspected of having a stroke or aneurysm). The method includes: administering, to a subject, an MMP-12 binding protein in an amount sufficient to treat the stroke or aneurysm in the subject. The method can further include providing to the subject a second therapy that is a therapy for stroke or aneurysm.

In another aspect, the disclosure features a method of treating nerve damage associated with excess or inappropriate activity of MMP-12 (e.g., spinal cord injury). The method includes: administering, to a subject, an MMP-12 binding protein in an amount sufficient to treat the nerve damage in the subject. In one embodiment, the method further includes administering a second therapy that is a therapy for nerve damage.

Other exemplary therapeutic methods that include administering an MMP-12 binding protein are described below. An MMP-12 binding protein described herein can be administered in combination with one or more other MMP inhibitors, e.g., small molecule inhibitors, e.g., broad specificity inhibitors. In one embodiment, the small molecule inhibitors are one or more of the small molecule inhibitors described herein. In another embodiment, the one or more MMP inhibitors include another MMP-12 binding protein, e.g., another MMP-12 binding protein described herein.

MMP-12 binding proteins are useful for targeted delivery of an agent to a subject (e.g., a subject who has or is suspected of having a tumor), e.g., to direct the agent to a tumor in the subject. For example, an MMP-12 binding protein that is coupled to an anti-tumor agent (such as a chemotherapeutic, toxin, drug, or a radionuclide (e.g., $^{131}$I, $^{90}$Y, $^{177}$Lu)) can be administered to a subject who has or is suspected of having a tumor.

In another aspect, the disclosure features a method of imaging a subject. The method includes administering an MMP-12 binding protein to the subject. In some embodiments, the protein is one that does not substantially inhibit MMP-12 catalytic activity. Exemplary MMP-12 binding proteins are described herein such as, e.g., M0013-A02, M0013-A03, M0013-A1, M0013-B07, M0013-B08, M0013-B10, M0013-D02, M0013-D04, M0013-D06, M0013-D10, M0013-E05, M0013-F07, M0013-G04, M0013-H04, M0014-A09, M0014-B09, M0014-D11, M0015-G04, M0016-A02, M0016-A04, M0016-C13, M0016-C10, M0016-D07, M0016-F03, M0016-H09, M0018-A05, M0018-D01, M0019-A10, M0019-C07, M0019-G07, M0019-G10, M0020-C08, M0020-H02, M0021-B03, M0021-D06, M0021-E12, M0021-G07, M0022-A02, M0023-B11, M0023-D03, M0023-D05, M0023-E09, M0023-H01, M0024-C02, M0025-F02, M0025-G01, M0025-H03, M0025-H11, M0026-A01, M0026-A05, M0026-A09, M0026-A10, M0026-B11, M0026-C03, M0026-C07, M0026-E01, M0026-E11, M0026-F03, M0026-F04, M0026-G12, M0026-H05, M0027-A08, M0027-B03, M0027-B08, M0027-C07, M0027-G02, M0027-H04, M0028-E09, M0028-F04, M0035-C05, M0040-A02, M0041-G04, M0007-A10, M0052-F03, M0041-A05, M0034-C04, M0038-D06, M0007-H06, M0038-A03, M0039-B02, M0035-D06, M0042-H01, M0040-C08, M0038-F09, M0040-E08, M0034-E11, M0008-E08, M0039-F01, M0030-A10, M0052-E10, M0040-A03, M0040-B05, M0041-G01, M0038-H04 and M0032-H09. Preferably, the MMP-12 binding protein is M0030-A10, M0032-H09, M0038-A03, M0038-H04, M0039-B02, M0040-B05, M0041-A05, R011-B11, M0007-A10 (also referred to as M7A10) or M0008-E08 (also referred to as M8E8). The MMP-12 binding protein may include a detectable label (e.g., a radionuclide or an MRI-detectable label). In one embodiment, the subject has or is suspected of having a tumor. The method is useful for cancer diagnosis, intraoperative tumor detection, post-operative tumor detection, or monitoring tumor invasive activity.

In one aspect, the disclosure features the use of an MMP-12 binding protein described herein for the manufacture of a medicament for the treatment of a disorder described herein, e.g., cancer, inflammation, cardiovascular disease, aneurysm, wound healing, aging, and nerve damage cancer, inflammation, cardiovascular disease, aneurysm, wound healing, aging, and nerve damage.

The details of one or more embodiments of the invention are set forth in the accompanying drawings and the description below. Other features, objects, and advantages of the invention will be apparent from the description and drawings, and from the claims.

The contents of all cited references including literature references, issued patents, published or non-published patent applications cited throughout this application as well as those listed below are hereby expressly incorporated by reference in their entireties. In case of conflict, the present application, including any definitions herein, will control.

DESCRIPTION OF DRAWINGS

FIG. 2A is a line graph showing human MMP-12 activity (Fluo/min) in the presence of increasing concentrations (nM) of an MMP-12 binding protein (539B-M08H09). FIG. 2B is a line graph showing the binding rate of elastin (dF/min) in the presence of increasing concentrations (nM) of an MMP-12 binding protein (539B-M08H09). FIG. 2C is a line graph showing murine MMP-12 activity (Fluo/sec) in the presence of increasing concentrations (nM) of an MMP-12 binding protein (539B-M08H09).

FIG. 3A is a line graph showing measured $IC_{50}$ (nM) of an MMP-12 binding protein (M08H09) versus substrate concentration (μM) of human MMP-12. FIG. 3B is a line graph showing measured $IC_{50}$ (nM) of an MMP-12 binding protein (M08H09) versus substrate concentration (μM) of murine MMP-12.

FIGS. 10A and 10B summarize the identification of amino acid changes in affinity matured variant HV-CDRs (cycles 1 and 2) that contribute to improvement in affinity and inhibition properties. The rows in FIG. 10B correspond to the rows in FIG. 10A. FIG. 10A discloses the HC-CDR1 column as SEQ ID NOS 3,335-3,356, the HC-CDR2 column as SEQ ID NOS 3,357-3,378 and the HC-CDR3 column as SEQ ID NOS 3,379-3,400.

DETAILED DESCRIPTION

Figure 1:
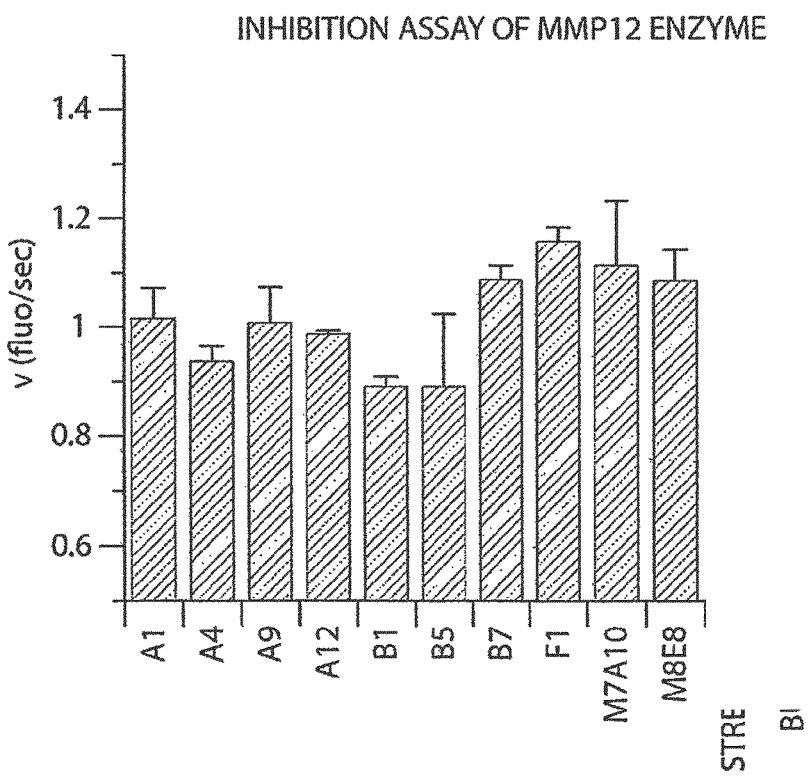
FIG. 1 is a graph depicting inhibition assays of MMP-12 using non-inhibitor binding proteins.
Figures 2A, 2B, 2C:
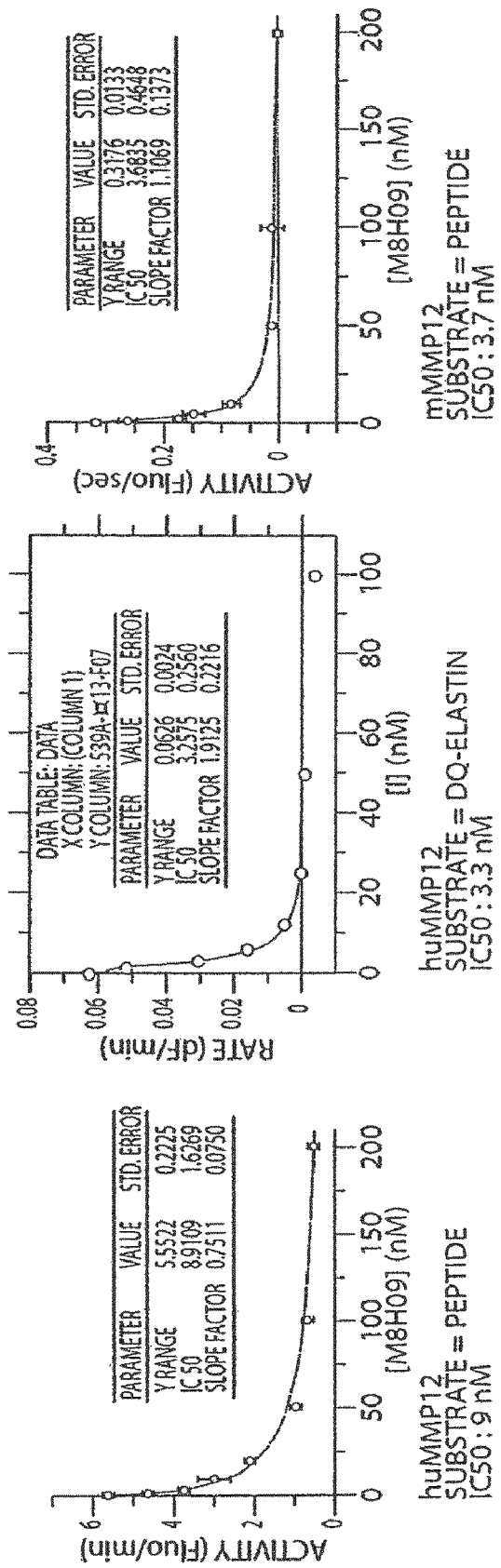
FIGS. 2A, 2B and 2C.

Matrix metalloproteinase-12 (MMP-12) is a type IV collagenase that is members of a group of secreted zinc metalloproteases which, in mammals, degrade various proteins of the extracellular matrix. Other members of this group include interstitial collagenase (MMP-1) and stromelysin (MMP-3). MMP-12 (a.k.a. macrophage elastase, macrophage metalloelastase, or matrix metalloproteinase 12) is thought to be involved in many disease states. Many small molecule inhibitors of MMP-12 have been tested for safety and efficacy in cancer and other diseases. So far, all have lacked either sufficient potency or sufficient specificity or both. The present disclosure provides proteins that bind MMP-12, and in some instances, inhibit MMP-12 activity. In many instances, the disclosed MMP-12 binding proteins bind and inhibit human and mouse MMP12 enzyme activity. In other instances, MMP-12 binding proteins are disclosed that bind MMP-12 but do not inhibit MMP-12 activity. Such MMP-12 binding proteins are useful, e.g., to determine the presence of MMP-12.

The term "binding protein" refers to a protein that can interact with a target molecule. This term is used interchangeably with "ligand." An "MMP-12 binding protein" refers to a protein that can interact with MMP-12, and includes, in particular, proteins that preferentially interact with and/or inhibit MMP-12. For example, the MMP-12 binding protein is an antibody.

The term "antibody" refers to a protein that includes at least one immunoglobulin variable domain or immunoglobulin variable domain sequence. For example, an antibody can include a heavy (H) chain variable region (abbreviated herein as VH), and a light (L) chain variable region (abbreviated herein as VL). In another example, an antibody includes two heavy (H) chain variable regions and two light (L) chain variable regions. The term "antibody" encompasses antigen-binding fragments of antibodies (e.g., single chain antibodies, Fab and sFab fragments, $F(ab')_2$, Fd fragments, Fv fragments, scFv, and domain antibodies (dAb) fragments (de Wildt et al., Eur J. Immunol. 1996; 26(3):629-39)) as well as complete antibodies. An antibody can have the structural features of IgA, IgG, IgE, IgD, IgM (as well as subtypes thereof). Antibodies may be from any source, but primate (human and non-human primate) and primatized are preferred The VH and VL regions can be further subdivided into regions of hypervariability, termed "complementarity determining regions" ("CDR"), interspersed with regions that are more conserved, termed "framework regions" ("FR"). The extent of the framework region and CDRs has been precisely defined (see, Kabat, E. A., et al. (1991) *Sequences of Proteins of Immunological Interest, Fifth Edition*, U.S. Department of Health and Human Services, NIH Publication No. 91-3242, and Chothia, C. et al. (1987) J. Mol. Biol. 196:901-917, see also www.hgmp.mrc.ac.uk). Kabat definitions are used herein. Each VH and VL is typically composed of three CDRs and four FRs, arranged from amino-terminus to carboxy-terminus in the following order: FR1, CDR1, FR2, CDR2, FR3, CDR3, FR4.

As used herein, an "immunoglobulin variable domain sequence" refers to an amino acid sequence which can form the structure of an immunoglobulin variable domain such that one or more CDR regions are positioned in a conformation suitable for an antigen binding site. For example, the sequence may include all or part of the amino acid sequence of a naturally-occurring variable domain. For example, the sequence may omit one, two or more N- or C-terminal amino acids, internal amino acids, may include one or more insertions or additional terminal amino acids, or may include other alterations. In one embodiment, a polypeptide that includes immunoglobulin variable domain sequence can associate with another immunoglobulin variable domain sequence to form an antigen binding site, e.g., a structure that preferentially interacts with an MMP-12 protein, e.g., the MMP-12 catalytic domain.

The VH or VL chain of the antibody can further include all or part of a heavy or light chain constant region, to thereby form a heavy or light immunoglobulin chain, respectively. In one embodiment, the antibody is a tetramer of two heavy immunoglobulin chains and two light immunoglobulin chains, wherein the heavy and light immunoglobulin chains are inter-connected by, e.g., disulfide bonds. In IgGs, the heavy chain constant region includes three immunoglobulin domains, CH1, CH2 and CH3. The light chain constant region includes a CL domain. The variable region of the heavy and light chains contains a binding domain that interacts with an antigen. The constant regions of the antibodies typically mediate the binding of the antibody to host tissues or factors, including various cells of the immune system (e.g., effector cells) and the first component (C1q) of the classical complement system. The light chains of the immunoglobulin may be of type kappa or lambda. In one embodiment, the antibody is glycosylated. An antibody can be functional for antibody-dependent cytotoxicity and/or complement-mediated cytotoxicity.

One or more regions of an antibody can be human or effectively human. For example, one or more of the variable regions can be human or effectively human. For example, one or more of the CDRs can be human, e.g., HC CDR1, HC CDR2, HC CDR3, LC CDR1, LC CDR2, and LC CDR3. Each of the light chain CDRs can be human. HC CDR3 can be human. One or more of the framework regions can be human, e.g., FR1, FR2, FR3, and FR4 of the HC or LC. For example, the Fc region can be human. In one embodiment, all the framework regions are human, e.g., derived from a human somatic cell, e.g., a hematopoietic cell that produces immunoglobulins or a non-hematopoietic cell. In one embodiment, the human sequences are germline sequences, e.g., encoded by a germline nucleic acid. In one embodiment, the framework (FR) residues of a selected Fab can be converted to the amino-acid type of the corresponding residue in the most similar primate germline gene, especially the human germline gene. One or more of the constant regions can be human or effectively human. For example, at least 70, 75, 80, 85, 90, 91, 92, 93, 94, 95, 96, 97, 98, 99, or 100% of an immunoglobulin variable domain, the constant region, the constant domains (CH1, CH2, CH3, CL1), or the entire antibody can be human or effectively human.

All or part of an antibody can be encoded by an immunoglobulin gene or a segment thereof. Exemplary human immunoglobulin genes include the kappa, lambda, alpha (IgA1 and IgA2), gamma (IgG1, IgG2, IgG3, IgG4), delta, epsilon and mu constant region genes, as well as the many immunoglobulin variable region genes. Full-length immunoglobulin "light chains" (about 25 KDa or about 214 amino acids) are encoded by a variable region gene at the $NH_2$-terminus (about 110 amino acids) and a kappa or lambda constant region gene at the COOH— terminus. Full-length immunoglobulin "heavy chains" (about 50 KDa or about 446 amino acids), are similarly encoded by a variable region gene (about 116 amino acids) and one of the other aforementioned constant region genes, e.g., gamma (encoding about 330 amino acids). The length of human HC varies considerably because HC CDR3 varies from about 3 amino-acid residues to over 35 amino-acid residues.

The term "antigen-binding fragment" of a full length antibody refers to one or more fragments of a full-length antibody that retain the ability to specifically bind to a target of interest. Examples of binding fragments encompassed within the term "antigen-binding fragment" of a full length antibody include (i) a Fab fragment, a monovalent fragment consisting of the VL, VH, CL and CH1 domains; (ii) a $F(ab')_2$ fragment, a bivalent fragment including two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) *Nature* 341:544-546), which consists of a VH domain; and (vi) an isolated complementarity determining region (CDR) that retains functionality. Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules known as single chain Fv (scFv). See e.g., U.S. Pat. Nos. 5,260,203, 4,946,778, and 4,881,175; Bird et al. (1988) *Science* 242:423-426; and Huston et al. (1988) *Proc. Natl. Acad. Sci. USA* 85:5879-5883.

Antibody fragments can be obtained using any appropriate technique including conventional techniques known to those with skill in the art. The term "monospecific antibody" refers to an antibody that displays a single binding specificity and affinity for a particular target, e.g., epitope. This term includes a "monoclonal antibody" or "monoclonal antibody composition," which as used herein refer to a preparation of antibodies or fragments thereof of single molecular composition, irrespective of how the antibody was generated.

An "effectively human" immunoglobulin variable region is an immunoglobulin variable region that includes a sufficient number of human framework amino acid positions such that the immunoglobulin variable region does not elicit an immunogenic response in a normal human. An "effectively human" antibody is an antibody that includes a sufficient number of human amino acid positions such that the antibody does not elicit an immunogenic response in a normal human.

A "humanized" immunoglobulin variable region is an immunoglobulin variable region that is modified to include a sufficient number of human framework amino acid positions such that the immunoglobulin variable region does not elicit an immunogenic response in a normal human. Descriptions of "humanized" immunoglobulins include, for example, U.S. Pat. No. 6,407,213 and U.S. Pat. No. 5,693,762.

As used herein, "binding affinity" refers to the apparent association constant or $K_a$. The $K_a$ is the reciprocal of the dissociation constant ($K_d$). A binding protein may, for example, have a binding affinity of at least $10^5$, $10^6$, $10^7$, $10^8$, $10^9$, $10^{10}$ and $10^{11}$ $M^{-1}$ for a particular target molecule, e.g., MMP-9, MMP-16, or MMP-24. Higher affinity binding of a binding protein to a first target relative to a second target can be indicated by a higher $K_a$ (or a smaller numerical value $K_d$) for binding the first target than the $K_a$ (or numerical value $K_d$) for binding the second target. In such cases, the binding protein has specificity for the first target (e.g., a protein in a first conformation or mimic thereof) relative to the second target (e.g., the same protein in a second conformation or mimic thereof; or a second protein). Differences in binding affinity (e.g., for specificity or other comparisons) can be at least 1.5, 2, 3, 4, 5, 10, 15, 20, 37.5, 50, 70, 80, 91, 100, 500, 1000, or $10^5$ fold.

Binding affinity can be determined by a variety of methods including equilibrium dialysis, equilibrium binding, gel filtration, ELISA, surface plasmon resonance, or spectroscopy (e.g., using a fluorescence assay). Exemplary conditions for evaluating binding affinity are in TRIS-buffer (50 mM TRIS, 150 mM NaCl, 5 mM $CaCl_2$ at pH7.5). These techniques can be used to measure the concentration of bound and free binding protein as a function of binding protein (or target) concentration. The concentration of bound binding protein ([Bound]) is related to the concentration of free binding protein ([Free]) and the concentration of binding sites for the binding protein on the target where (N) is the number of binding sites per target molecule by the following equation:

$$[Bound] = N \cdot [Free]/((1/Ka)+[Free]).$$

It is not always necessary to make an exact determination of $K_a$, though, since sometimes it is sufficient to obtain a quantitative measurement of affinity, e.g., determined using a method such as ELISA or FACS analysis, is proportional to $K_a$, and thus can be used for comparisons, such as determining whether a higher affinity is, e.g., 2-fold higher, to obtain a qualitative measurement of affinity, or to obtain an inference of affinity, e.g., by activity in a functional assay, e.g., an in vitro or in vivo assay.

An "isolated composition" refers to a composition (e.g., protein) that is removed from at least 90% of at least one component of a natural sample from which the isolated composition can be obtained. Compositions produced artificially or naturally can be "compositions of at least" a certain degree of purity if the species or population of species of interests is at least 5, 10, 25, 50, 75, 80, 90, 92, 95, 98, or 99% pure on a weight-weight basis.

An "epitope" refers to the site on a target compound that is bound by a binding protein (e.g., an antibody such as a Fab or full length antibody). In the case where the target compound is a protein, the site can be entirely composed of amino acid components, entirely composed of chemical modifications of amino acids of the protein (e.g., glycosyl moieties), or composed of combinations thereof. Overlapping epitopes include at least one common amino acid residue, glycosyl group, phosphate group, sulfate group, or other molecular feature.

Calculations of "homology" or "sequence identity" between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frameshift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences.

In a preferred embodiment, the length of a reference sequence aligned for comparison purposes is at least 30%, preferably at least 40%, more preferably at least 50%, even more preferably at least 60%, and even more preferably at least 70%, 80%, 85%, 90%, 91%, 92%, 93%, 94%, 95%, 96%, 97%, 98%, 99%, or 100% of the length of the reference sequence. For example, the reference sequence may be the length of the immunoglobulin variable domain sequence.

As used herein, the term "substantially identical" (or "substantially homologous") is used herein to refer to a first amino acid or nucleic acid sequence that contains a sufficient number of identical or equivalent (e.g., with a similar side chain, e.g., conserved amino acid substitutions) amino acid residues or nucleotides to a second amino acid or nucleic acid sequence such that the first and second amino acid or nucleic acid sequences have (or encode proteins having) similar activities, e.g., a binding activity, a binding preference, or a biological activity. In the case of antibodies, the second antibody has the same specificity and has at least 50%, at least 25%, or at least 10% of the affinity relative to the same antigen.

Sequences similar or homologous (e.g., at least about 85% sequence identity) to the sequences disclosed herein are also part of this application. In some embodiments, the sequence identity can be about 85%, 90%, 91%, 92%, 93%, 94%, 95%, 96%, 97%, 98%, 99% or higher. In addition, substantial identity exists when the nucleic acid segments hybridize under selective hybridization conditions (e.g., highly stringent hybridization conditions), to the complement of the strand. The nucleic acids may be present in whole cells, in a cell lysate, or in a partially purified or substantially pure form.

As used herein, the term "hybridizes under low stringency, medium stringency, high stringency, or very high stringency conditions" describes conditions for hybridization and washing. Guidance for performing hybridization reactions can be found in *Current Protocols in Molecular Biology*, John Wiley & Sons, N.Y. (1989), 6.3.1-6.3.6. Aqueous and nonaqueous methods are described in that reference and either can be used. Specific hybridization conditions referred to herein are as follows: (1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); (2) medium stringency hybridization conditions in 6×SSC at about 45° C., followed by one or more washes in 0.2×SSC, 0.1% SDS at 60° C.; (3) high stringency hybridization conditions in 6×SSC at about 45° C., followed by one or more washes in 0.2×SSC, 0.1% SDS at 65° C.; and (4) very high stringency hybridization conditions are 0.5M sodium phosphate, 7% SDS at 65° C., followed by one or more washes at 0.2×SSC, 1% SDS at 65° C. Very high stringency conditions (4) are the preferred conditions and the ones that should be used unless otherwise specified. The disclosure includes nucleic acids that hybridize with low, medium, high, or very high stringency to a nucleic acid described herein or to a complement thereof, e.g., nucleic acids encoding a binding protein described herein. The nucleic acids can be the same length or within 30, 20, or 10% of the length of the reference nucleic acid. The nucleic acid can correspond to a region encoding an immunoglobulin variable domain sequence described herein.

An MMP-12 binding protein may have mutations (e.g., at least one, two, or four, and/or less than 15, 10, 5, or 3) relative to a binding protein described herein (e.g., conservative or non-essential amino acid substitutions), which do not have a substantial effect on protein function. Whether or not a particular substitution will be tolerated, i.e., will not adversely affect biological properties, such as binding activity can be predicted, e.g., by evaluating whether the mutation is conservative or by the method of Bowie, et al. (1990) *Science* 247:1306-1310.

A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). It is possible for many framework and CDR amino acid residues to include one or more conservative substitutions.

Motif sequences for biopolymers can include positions which can be varied amino acids. For example, the symbol "X" in such a context generally refers to any amino acid (e.g., any of the twenty natural amino acids or any of the nineteen non-cysteine amino acids). Other allowed amino acids can also be indicated for example, using parentheses and slashes. For example, "(A/W/F/N/Q)" means that alanine, tryptophan, phenylalanine, asparagine, and glutamine are allowed at that particular position.

A "non-essential" amino acid residue is a residue that can be altered from the wild-type sequence of the binding agent, e.g., the antibody, without abolishing or more preferably, without substantially altering a biological activity, whereas changing an "essential" amino acid residue results in a substantial loss of activity.

The term "cognate ligand" refers to a naturally occurring ligand of an MMP-12, including naturally occurring variants thereof (e.g., splice variants, naturally occurring mutants, and isoforms).

Statistical significance can be determined by any art known method. Exemplary statistical tests include: the Students T-test, Mann Whitney U non-parametric test, and Wilcoxon non-parametric statistical test. Some statistically significant relationships have a P value of less than 0.05 or 0.02. Particular binding proteins may show a difference, e.g., in specificity or binding, that are statistically significant (e.g., P value <0.05 or 0.02). The terms "induce", "inhibit", "potentiate", "elevate", "increase", "decrease" or the like, e.g., which denote distinguishable qualitative or quantitative differences between two states, and may refer to a difference, e.g., a statistically significant difference, between the two states.

MMP-12 Binding Proteins

The disclosure provides proteins that bind to MMP-12 (e.g., human MMP-12 and/or murine MMP-12) and include at least one immunoglobin variable region. For example, the MMP-12 binding protein includes a heavy chain (HC) immunoglobulin variable domain sequence and a light chain (LC) immunoglobulin variable domain sequence. A number of exemplary MMP-12 binding proteins are described herein.

The MMP-12 binding protein may be an isolated protein (e.g., at least 70, 80, 85, 90, 91, 92, 93, 94, 95, 96, 97, 98, or 99% free of other proteins).

The MMP-12 binding protein may additionally inhibit MMP-12, e.g., human and/or murine MMP-12. The binding protein can inhibit the catalytic activity of MMP-12 (e.g., human MMP-12). In one embodiment, the protein binds the catalytic domain of human MMP-12, e.g., the protein contacts residues in or near the active site of MMP-12. In some embodiments, the protein does not contact residues in or near the active site of MMP-12 but instead binds elsewhere on MMP-12 and causes a steric change in MMP-12 that affects (e.g., inhibits) its activity.

Exemplary MMP-12 binding proteins include M0134-A02, M134-A05, M134-A07, M134-A09, M134-A10, M134-A 11, M0134-B01, M134-B04, M134-B08, M0134-B 11, M0134-C01, M0134-C02, M0134-C06, M0134-C09, M0134-C10, M0134-C11, M0134-C12, M0134-D02, M0134-DO3, M0134-E04, M0134-E07, M0134-E08, M134-E11, M0134-F01, M0134-F05, M0134-G02, M0134-G04, M0134-G07, M0135-A03, M0135-A05, M0135-A06, M0135-A07, M0135-B02, M0135-B08, M0135-C01, M0135-C11, M0135-E03, M0135-F03, M0135-F11, M0135-G02, M0135-G03, M0135-G07, M0135-G11, M0135-H03, M0135-H10, M0105-C05, M0105-E11, M0105-F08, M0107-A12, M0108-A02, M0109-G11, M0110-G05, M0129-B11, M0130-A01, M0130-C12, M0130-F06, M0130-H04, M0131-A06, M0131-D03, M0132-A04, M0133-B08, M0133-E05, M0121-E07, M0118-F11, M0125-G07, M0124-E07, M0119-D01, M0119-A02, M0122-C06, M0123-G07, M0063-A02, M0063-A04, M0063-B01, M0063-B11, M0063-C07, M0063-G01, M0065-E12, M0065-G03, M0065-H05, M0067-A02, M0067-B06, M0067-B09, M0067-C10, M0067-F02, M0067-F06, M0069-A04, M0069-A11, M0069-C02, M0069-D10, M0069-G07, M0071-A01, M0071-B07, M0071-D05, M0071-D09, M0071-H03, M0071-H06, M0087-F09, M0088-F07, M0088-G10, M0088-H10, M0089-C01, M0089-F05, M0089-B07, M0089-H11, M0034-C04, M0039-F01, M0041-B05, M0041-G01, M0042-B06, M0006-B10, M0007-H06, M0008-H09, M0009-H08, M0011-H11, M0015-F02, M0016-D01, M0013-D11, M0013-G12, M0013-H06, M0014-C09, M0014-G11, M0016-A11, M0016-H05, M0019-C05, M0020-B01, M0022-C07, M0025-D04 and M0027-E11. Preferably, the MMP-12 binding protein is M0030-A10, M0008-H09, M0032-H09, M0038-A03, M0038-H04, M0039-B02, M0040-B05, M0041-A05, R011-B11, M0007-A10 (also referred to as M7A10) or M0008-E08 (also referred to as M8E8).

MMP-12 binding proteins may be antibodies. MMP-12 binding antibodies may have their HC and LC variable domain sequences included in a single polypeptide (e.g., scFv), or on different polypeptides (e.g., IgG or Fab).

Matrix Metalloproteinase 12 (MMP-12)

MMP-12 Sequences. MMP-12 is encoded by a gene designated as MMP12 with full name Matrix metalloproteinase-12 precursor. Synonyms for MMP-12 include matrix metalloproteinase 12, macrophage elastase, macrophage metalloelastase. The DNA sequence is known for *Homo sapiens* and *Mus musculus*. An exemplary cDNA sequence encoding human MMP12 and the amino acid sequence are shown below. Exemplary cDNA sequences encoding murine MMP12 and amino acid sequences are also shown below. An exemplary MMP-12 protein can include the human or mouse MMP-12 amino acid sequence, a sequence that is 80%, 85%, 90%, 95%, 96%, 97%, 98%, or 99% identical to one of these sequences, or a fragment thereof, e.g., a fragment without the signal sequence or prodomain.

```
cDNA and amino acid sequences of human MMP12
>emb1|BC112301|BC112301 Homo sapiens matrix metallopeptidase 12
(macrophage elastase), mRNA (cDNA clone MGC: 138506 IMAGE: 8327769),
complete cds
                                                        (SEQ ID NO: 2)

atgaagtttcttctaatactgct cctgcaggccactgcttctggagctcttccctgaacagctctacaagcctggaaaaaaa taatgtgctatttggtgaaagatacttagaaaaattttatggccttgagataaacaaact tccagtgacaaaaatgaaatatagtggaaacttaatgaaggaaaaaatccaagaaatgca gcacttcttgggtctgaaagtgaccgggcaactggacacatctaccctggagatgatgca cgcacctcgatgtggagtccccgatgtccatcatttcagggaaatgccaggggggcccgt atggaggaaacattatatcacctacagaatcaataattacacacctgacatgaaccgtga ggatgttgactacgcaatccggaaagctttccaagtatggagtaatgttacccccttgaa attcagcaagattaacacaggcatggctgacattttggtggttttttgcccgtggagctca tggagacttccatgcttttgatggcaaaggtggaatcctagcccatgcttttggacctgg atctggcattggagggggatgcacatttcgatgaggacgaattctggactacacattcagg aggcacaaacttgttcctcactgctgttcacgagattggccattccttaggtcttggcca ttctagtgatccaaaggccgtaatgttccccacctacaaatatgttgacatcaacacatt tcgcctctctgctgatgacatacgtggcattcagtccctgtatggagacccaaaagagaa ccaacgcttgccaaatcctgacaattcagaaccagctctctgtgaccccaatttgagttt tgatgctgtcactaccgtgggaaataagatcttttcttcaaagacaggttcttctggct gaaggtttctgagagaccaaagaccagtgttaatttaatttcttccttatggccaacctt gccatctggcattgaagctgcttatgaaattgaagccagaaatcaagttttcttttta agatgacaaatactggttaattagcaatttaagaccagagccaaattatcccaagagcat acattcttttggttttcctaactttgtgaaaaaattgatgcagctgttttaacccacg tttttataggacctacttctttgtagataaccagtattggaggtatgatgaaaggagaca gatgatggaccctggttatcccaaactgattaccaagaacttccaaggaatcgggcctaa aattgatgcagtcttctactctaaaaacaaatactactattcttccaaggatctaacca atttgaatatgacttcctactccaacgtatcaccaaaacactgaaaagcaatagctggtt tggttgttagaaatggtgtaattaatggttttttgttagttcacttcagcttaataagtat ttattgcatatttgctatgtcctcagtgtaccactacttagagatatgtatcataaaaat aaaatctgtaaaccataggtaatgattatataaaatacataatattttttcaattttgaaa actctaattgtccattcttgcttgactctactattaagtttgaaaatagttaccttcaaa
```

-continued
ggccaagagaattctatttgaagcatgctctgtaagttgcttcctaacat

>Amino acid sequence of human MMP12 (AAI12302.1)
(SEQ ID NO: 3)

MKFLLILLLQATASGALPLNSSTSLEKNNVLFGERYLEKFYGLEINKLPVTKMKYSGNLM

KEKIQEMQHFLGLKVTGQLDTSTLEMMHAPRCGVPDVHHFREMPGGPVWRKHYITYRINN

YTPDMNREDVDYAIRKAFQVWSNVTPLKFSKINTGMADILVVFARGAHGDFHAFDGKGGI

LAHAFGPGSGIGGDAHFDEDEFWTTHSGGTNLFLTAVHEIGHSLGLGHSSDPKAVMFPTY

KYVDINTFRLSADDIRGIQSLYGDPKENQRLPNPDNSEPALCDPNLSFDAVTTVGNKIFF

FKDRFFWLKVSERPKTSVNLISSLWPTLPSGIEAAYEIEARNQVFLFKDDKYWLISNLRP

EPNYPKSIHSFGFPNFVKKIDAAVFNPRFYRTYFFVDNQYWRYDERRQMMDPGYPKLITK

NFQGIGPKIDAVFYSKNKYYYFFQGSNQFEYDFLLQRITKTLKSNSWFGC

Polymorphisms in the MMP-12 gene are described, for example, in (2002) *J Am Coll Cardiol.* 3:40(1):43-8, (2002) *Hum Mol Genet.* 1:11(5):569-76, (2001) *Stroke* 32(9):2198-202, and (2000) *Circ Res.* 86(9):998-1003.

```
cDNA and amno acid sequences of mouse MMP12
> Mouse MMP-12 cDNA sequence (NM_008605)
                                                      (SEQ ID NO: 4)
   1 ACTCTGCTGAAAGGAGTCTGCACAATGAAATTTCTCATGATGATTGTGTTCTTACAGGTA

61 TCTGCCTGTGGGGCTGCTCCCATGAATGACAGTGAATTTGCTGAATGGTACTTGTCAAGA

121 TTTTATGATTATGGAAAGGACAGAATTCCAATGACAAAAACAAAAACCAATAGAAACTTC

181 CTAAAAGAAAAACTCCAGGAAATGCAGCAGTTCTTTGGGCTAGAAGCAACTGGGCAACTG

241 GACAACTCAACTCTGGCAATAATGCACATCCCTCGATGTGGAGTGCCCGATGTACAGCAT

301 CTTAGAGCAGTGCCCCAGAGGTCAAGATGGATGAAGCGGTACCTCACTTACAGGATCTAT

361 AATTACACTCCGGACATGAAGCGTGAGGATGTAGACTACATATTTCAGAAAGCTTTCCAA

421 GTCTGGAGTGATGTGACTCCTCTAAGATTCAGAAAGCTTCATAAAGATGAGGCTGACATT

481 ATGATACTTTTTGCATTTGGAGCTCACGGAGACTTCAACTATTTTGATGGCAAAGGTGGT

541 ACACTAGCCCATGCTTTTTATCCTGGACCTGGTATTCAAGGAGATGCACATTTTGATGAG

601 GCAGAAACGTGGACTAAAAGTTTTCAAGGCACAAACCTCTTCCTTGTTGCTGTTCATGAA

661 CTTGGCCATTCCTTGGGGCTGCAGCATTCCAATAATCCAAAGTCAATAATGTACCCCACC

721 TACAGATACCTTAACCCCAGCACATTTCGCCTCTCTGCTGATGACATACGTAACATTCAG

781 TCCCTCTATGGAGCCCCAGTGAAACCCCCATCCTTGACAAAACCTAGCAGTCCACCATCA

841 ACTTTCTGTCACCAAAGCTTGAGTTTTGATGCTGTCACAACAGTGGGAGAGAAAATCTTT

901 TTCTTTAAAGACTGGTTCTTCTGGTGGAAGCTTCCTGGGAGTCCAGCCACCAACATTACT

961 TCTATTTCTTCCATATGGCCAAGCATCCCATCTGGTATTCAAGCTGCTTACGAAATTGAA

1021 AGCAGAAATCAACTTTTCCTTTTTAAAGATGAGAAGTACTGGTTAATAAACAACTTAGTA

1081 CCAGAGCCACACTATCCCAGGAGCATATATTCCCTGGGCTTCTCTGCATCTGTGAAGAAG

1141 GTTGATGCAGCTGTCTTTGACCCACTTCGCCAAAAGGTTTATTTCTTTGTGGATAAACAC

1201 TACTGGAGGTATGATGTGAGGCAGGAGCTCATGGACCCTGCTTACCCCAAGCTGATTTCC

1261 ACACACTTCCCAGGAATCAAGCCTAAAATTGATGCAGTCCTCTATTTCAAAAGACACTAC

1321 TACATCTTCCAAGGAGCCTATCAATTGGAATATGACCCCCTGTTCCGTCGTGTCACCAAA

1381 ACATTGAAAAGTACAAGCTGGTTTGGTTGT

>Amino acid sequence of mouse MMP12 (based on accession number
NM_008605)
```

-continued (SEQ ID NO: 5)

MKFLMMIVFLQVSACGAAPMNDSEFAEWYLSRFYDYGKDRIPMTKTKTN

RNFLKEKLQEMQQFFGLEATGQLDNSTLAIMHIPRCGVPDVQHLRAVPQ

RSRWMKRYLTYRIYNYTPDMKREDVDYIFQKAFQVWSDVTPLRFRKLHK

DEADIMILFAFGAHGDFNYFDGKGGTLAHAFYPGPGIQGDAHFDEAETW

TKSFQGTNLFLVAVHELGHSLGLQHSNNPKSIMYPTYRLNPSTFRLSA

DDIRNIQSLYGAPVKPPSLTKPSSPPSTFCHQSLSFDAVTTVGEKIFFF

KDWFFWWKLPGSPATNITSISSIWPSIPSGIQAAYEIESRNQLFLFKDE

KYWLINNLVPEPHYPRSIYSLGFSASVKKVDAAVFDPLRQKVYFFVDKH

YWRYDVRQELMDPAYPKLISTHFPGIKPKIDAVLYFKRHYYIFQGAYQL

EYDPLFRRVTKTLKSTSWFGC

Factors that regulate MMP-12. Expression of MMP-12 is regulated by many factors. Reports of upregulation include: Oncogene. 2004 Jan. 22; 23(3):845-51. (recurrence in stage I lung cancer, 2/10 cases), Ann Neurol. 2003 June; 53(6):731-42. (collagenase-induced rat model of intracerebral hemorrhage), Cancer Res. 2005 May 15; 65(10):4261-72. (protein kinase C/p53 resistant cells), Br J. Dermatol. 2005 April; 152(4):720-6. (Samples from nine patients with squamous cell carcinoma), Cardiovasc Res. 2005 May 1; 66(2):410-9. (Aging), J. Immunol. 2005 Apr. 15; 174(8):4953-9. (Surfactant protein D–/– mice), J Biol. Chem. 2005 Jun. 3; 280(22): 21653-60. (Corneal wound repair), Surgery. 2005 April; 137 (4):457-62. (periaortic application of $CaCl_2$ in mice), J. Virol. 2005 April; 79(8):4764-73. (murine viral encephalitis), Biochem Biophys Res Commun. 2005 Apr. 29; 330(1):194-203. (cigarette smoke condensate in mice), Inflamm Res. 2005 January; 54(1):31-6. (bronchoalveolar lavage and lung tissue from COPD patients), Am J Respir Cell Mol. Biol. 2005 April; 32(4):311-8. (Induction of human IL-1 beta in transgenic mice), Toxicol Pathol. 2004 May-June; 32(3):351-6. (Cigarette smoke in mice), Am J Physiol Lung Cell Mol. Physiol. 2004 April; 286(4):L801-7. (lysosomal acid lipase gene knockout mice), J. Neurosci. 2004 Feb. 11; 24(6):1521-9. (A1 adenosine receptor null mice), J. Neuroimmunol. 1998 Jul. 1; 87(1-2):62-72. (experimentally-induced delayed type hypersensitivity model of MS), Scand J. Immunol. 2005 January; 61(1):10-7. (IL-4), J Pediatr Gastroenterol Nutr. 2005 January; 40(1):60-6. (Enterocolitis), J Cell Physiol. 2005 July; 204(1):139-45. (Statins), J. Immunol. 2004 Oct. 15; 173(8):5209-18. (experimental autoimmune encephalomyelitis), J Cardiovasc Pharmacol. 2004 July; 44(1):57-65. (hypercholesterolemic hamsters with endothelial injury in the carotid artery), Cancer Metastasis Rev. 2004 January-June; 23(1-2):101-17. (colorectal cancer), Free Radic Biol Med. 2004 Mar. 15; 36(6):782-801. (oxidative stress), Chest. 2004 February; 125(2):466-72. (Wood smoke, cigarette smoke, CPOD).

Down regulation or no upregulation is reported in Inflammation. 2003 April; 27(2):107-13. (Mice immunized with type II collagen), Cancer Res. 2003 Jan. 1; 63(1):256-62. (Epstein-Barr virus proteins; nasopharyngeal carcinoma), Curr Eye Res. 1998 February; 17(2):132-40. (human interphotoreceptor matrix and vitreous from postmortem human eyes), and Scand J. Immunol. 2005 January; 61(1):10-7 (dexamethasone).

Endogenous inhibitors of MMP-12. MMP-12 has a number of endogenous inhibitors. Like other MMPs, MMP-12 is inhibited by TIMPs (Murphy, G., and Willenbrock, F. (1995) Methods Enzymol. 248, 496-510).

Small molecule inhibitors of MMP-12. Small molecule inhibitors of MMP-12 have been synthesized and tested. Most of these have either insufficient potency or insufficient specificity, or both. The reports include: Proc Natl Acad Sci USA. 2005 Apr. 12; 102(15):5334-9. (acetohydroxamic acid and N-isobutyl-N-[4-methoxyphenylsulfonyl]glycyl hydroxamic acid); Arthritis Rheum. 2004 October; 50(10):3275-85. (a general hydroxamate inhibitor of MMP activity); Arch Biochem Biophys. 2003 Jan. 15; 409(2):335-40. (peptide lin24); J Mol. Biol. 2001 Sep. 28; 312(4):743-51. (hydroxamic acid inhibitor, CGS27023A); J Mol. Biol. 2001 Sep. 28; 312(4):731-42. (batimastat (BB-94)); Anticancer Res. 2001 January-February; 21(1A): 145-55. (AE-941, an orally bioavailable extract made of cartilage); J Comb Chem. 2000 November-December; 2(6):624-38. (XXX-Gpsi(PO2H—CH2)L-XXX library on beads); Biochim Biophys Acta. 2000 Mar. 16; 1478(1):51-60. (green tea polyphenols); J Leukoc Biol. 1984 May; 35(5):449-57. (peptide chloromethyl ketone); Am Rev Respir Dis. 1982 February; 125(2):203-7. (a battery of elastase inhibitors); Mem Inst Oswaldo Cruz. 2005 March; 100:167-172. (marimastat); J Mol. Biol. 2004 Aug. 20; 341(4):1063-76. (CP-271485, PF-00356231, and PD-0359601); Inflamm Res. 2003 March; 52(3):95-100.[1]; Bioorg Med Chem Lett. 2004 Oct. 4; 14(19):4935-9. (inhibitors with novel oxazoline zinc binding groups); and J Cardiovasc Pharmacol. 2004 July; 44(1):57-65. (ONO-4817). Other small molecule inhibitors of MMP-12 are described, e.g., in US Patent Application No: 20050014817 (Fluorothiophene derivatives), US Patent Application No.: 20050014816 (Thiophene amino acid derivatives), U.S. Pat. No. 6,770,640 (1-Carboxylmethyl-2-oxo-azepan derivatives), PCT Publication No.: WO200040577 (1-Carboxymethyl-2-Oxo-Azepan Derivatives), PCT Publication No.: WO 200532541 (Substituted Heterocyclic Mercaptosulfide Inhibitors), PCT Publication No.: WO 200183431, US Patent Application 20030158155, European Patent No.: 1288199, PCt Publication No.: WO 200040600 and U.S. Pat. No. 6,352,976, U.S. Pat. No. 6,350,907, U.S. Pat. No. 6,924,276, U.S. Pat. No. 6,916,807, U.S. Pat. No. 6,686,355, U.S. Pat. No. 6,548,477 and U.S. Pat. No. 5,506,242. The small molecule can be administered to inhibit MMP-12, e.g., in combination with a MMP-12 binding protein described herein.

Small interfering RNA inhibitors of MMP-12. MMP-12 can be inhibited by small interfering RNA (siRNA). Examples of siRNA that can be used are described in US Patent Publication No.: 20040087533 and PCt Publication No.: WO 200409098. The siRNA can be administered to inhibit MMP-12, e.g., in combination with a MMP-12 binding protein described herein.

Drug Conjugates

The MMP-12 binding proteins described herein can be conjugated to a drug (e.g., a cytotoxic, cytostatic, or immunomodulatory agent). The conjugates can be used therapeutically or prophylactically, e.g., the binding protein can target the drug, e.g., in vivo, e.g., to a site of disease (e.g., a tumor or site of inflammation), e.g., such that the drug affects the site of disease (e.g., causes a cytostatic or cytotoxic effect on targeted cells).

In some embodiments, the binding protein itself has therapeutic or prophylactic efficacy (e.g., the protein can modulate (e.g., antagonize) MMP-12, or cause a cytostatic or cytotoxic effect on a cell that expresses MMP-12 (e.g., an endothelial cell or tumor cell)). The binding protein-drug conjugate can be used such that the binding protein and drug both contribute (e.g., additively or synergistically) to an effect on MMP-12 (e.g., a therapeutic effect, e.g., in vivo, e.g., to a site of disease (e.g., a tumor or site of undesired angiogenesis or vascularization). The drug and/or binding protein can be, for example, cytotoxic, cytostatic or otherwise prevent or reduce the ability of a targeted cell to divide and/or survive (e.g., when the drug is taken up or internalized by the targeted cell and/or upon binding of the binding protein to MMP-12). For example, if the targeted cell is a cancer cell, the drug and/or binding protein can prevent or reduce the ability of the cell to divide and/or metastasize.

Useful classes of drugs that can be used in the binding protein-drug conjugates described herein include cytotoxic or immunomodulatory agents such as, for example, antitubulin agents, auristatins, DNA minor groove binders, DNA replication inhibitors, alkylating agents (e.g., platinum complexes such as cis-platin, mono(platinum), bis(platinum) and trinuclear platinum complexes and carboplatin), anthracyclines, antibiotics, antifolates, antimetabolites, chemotherapy sensitizers, duocarmycins, etoposides, fluorinated pyrimidines, ionophores, lexitropsins, nitrosoureas, platinols, pre-forming compounds, purine antimetabolites, puromycins, radiation sensitizers, steroids, taxanes, topoisomerase inhibitors, vinca alkaloids, or the like.

Individual cytotoxic or immunomodulatory agents include, for example, an androgen, anthramycin (AMC), asparaginase, 5-azacytidine, azathioprine, bleomycin, busulfan, buthionine sulfoximine, camptothecin, carboplatin, carmustine (BSNU), CC-1065, chlorambucil, cisplatin, colchicine, cyclophosphamide, cytarabine, cytidine arabinoside, cytochalasin B, dacarbazine, dactinomycin (actinomycin), daunorubicin, decarbazine, docetaxel, doxorubicin, an estrogen, 5-fluorodeoxyuridine, 5-fluorouracil, gramicidin D, hydroxyurea, idarubicin, ifosfamide, irinotecan, lomustine (CCNU), mechlorethamine, melphalan, 6-mercaptopurine, methotrexate, mithramycin, mitomycin C, mitoxantrone, nitroimidazole, paclitaxel, plicamycin, procarbazine, rapamycin (Sirolimus), streptozotocin, tenoposide, 6-thioguanine, thioTEPA, topotecan, vinblastine, vincristine, vinorelbine, VP-16 and VM-26.

In some typical embodiments, the drug comprises a cytotoxic agent. Suitable cytotoxic agents include, for example, dolastatins (e.g., auristatin E, AFP, MMAF, MMAE), DNA minor groove binders (e.g., enediynes and lexitropsins), duocarmycins, taxanes (e.g., paclitaxel and docetaxel), puromycins, vinca alkaloids, CC-1065, SN-38, topotecan, morpholino-doxorubicin, rhizoxin, cyanomorpholino-doxorubicin, echinomycin, combretastatin, netropsin, epothilone A and B, estramustine, cryptophysins, cemadotin, maytansinoids, discodermolide, eleutherobin, and mitoxantrone.

In some embodiments, the drug is a cytotoxic agent such as AFP, MMAF, MMAE, AEB, AEVB, auristatin E, paclitaxel, docetaxel, CC-1065, SN-38, topotecan, morpholino-doxorubicin, rhizoxin, cyanomorpholino-doxorubicin, dolastatin-10, echinomycin, combretatstatin, chalicheamicin, maytansine, DM-1, or netropsin.

In some embodiments, the drug is a cytotoxic agent that comprises a conventional chemotherapeutic such as, for example, doxorubicin, paclitaxel, melphalan, vinca alkaloids, methotrexate, mitomycin C or etoposide. In some embodiments, the drug can be a combined therapy, such as CHOP (Cyclophosphamide, Doxorubicin, Prednisolone and Vincristine), CHOP-R (Cyclophosphamide, Doxorubicin Vincristine, Prednisolone, and rituximab) or ABVD (Doxorubicin, Bleomycin, Vinblastine and Dacarbazine). Agents such as CC-1065 analogues (e.g., DC1), calicheamicin, maytansine, analogues of dolastatin 10, rhizoxin, and palytoxin can also be used.

In specific embodiments, the drug can be a cytotoxic or cytostatic agent that comprises auristatin E (also known in the art as dolastatin-10) or a derivative thereof. Typically, the auristatin E derivative is, e.g., an ester formed between auristatin E and a keto acid. For example, auristatin E can be reacted with paraacetyl benzoic acid or benzoylvaleric acid to produce AEB and AEVB, respectively. Other auristatin derivatives include AFP, MMAF, and MMAE. The synthesis and structure of auristatin E and its derivatives are described in US 20030083263 and US 20050009751, and U.S. Pat. Nos. 6,323,315; 6,239,104; 6,034,065; 5,780,588; 5,665,860; 5,663,149; 5,635,483; 5,599,902; 5,554,725; 5,530,097; 5,521,284; 5,504,191; 5,410,024; 5,138,036; 5,076,973; 4,986,988; 4,978,744; 4,879,278; 4,816,444; and 4,486,414. In some preferred embodiments, MMAF or AFP is used.

In specific embodiments, the drug is a cytotoxic agent that comprises a DNA minor groove binding agent. See, e.g., U.S. Pat. No. 6,130,237. For example, in some embodiments, the minor groove binding agent is a CBI compound. In other embodiments, the minor groove binding agent is an enediyne (e.g., calicheamicin).

Examples of anti-tubulin agents that can be used in the MMP-12 binding protein-drug conjugates include, but are not limited to, taxanes (e.g., TAXOL® (paclitaxel), TAXOTERE® (docetaxel)), T67 (Tularik), vinca alkyloids (e.g., vincristine, vinblastine, vindesine, and vinorelbine), and dolastatins (e.g., auristatin E, AFP, MMAF, MMAE, AEB, AEVB). Other antitubulin agents include, for example, baccatin derivatives, taxane analogs (e.g., epothilone A and B), nocodazole, colchicine and colcimid, estramustine, cryptophysins, cemadotin, maytansinoids, combretastatins, discodermolide, eleutherobin, rhizoxin/maytansine, auristatin dolastatin 10 MMAE, and peloruside A.

In some embodiments, the drug is a cytotoxic agent such as an anti-tubulin agent. In some embodiments, the anti-tubulin agent is an auristatin, a vinca alkaloid, a podophyllotoxin, a taxane, a baccatin derivative, a cryptophysin, a maytansinoid, a combretastatin, or a dolastatin. In some embodiments, the antitubulin agent is AFP, MMAP, MMAE, AEB, AEVB, auristatin E, vincristine, vinblastine, vindesine, vinorelbine, VP-16, camptothecin, paclitaxel, docetaxel, epothilone A, epothilone B, nocodazole, colchicines, colcimid, estramustine, cemadotin, discodermolide, maytansine, DM1, DM2, DM3, DM4, or eleutherobin.

In some embodiments, the cytotoxic agent comprises a maytansinoid, another group of anti-tubulin agents. For example, in specific embodiments, the maytansinoid is maytansine or DM-1 (ImmunoGen, Inc.; see also Chari et al. *Cancer Res.* 52:127-131 (1992)). In some embodiments, sterically hindered thiol and disulfide-containing maytansinoids in which the alpha-carbon atom bearing the sulfur atom bears one or two alkyl substituents are used in the binding protein-drug conjugate, e.g., US 2007-0292422; US 2007-0264266.

In some embodiments, the drug comprises an agent that acts to disrupt DNA. The drug may be selected from enediynes (e.g., calicheamicin and esperamicin) and non-enediyne small molecule agents (e.g., bleomycin, methidium-propyl-EDTA-Fe(II)). Other useful drugs include daunorubicin, doxorubicin, distamycin A, cisplatin, mitomycin C, ecteinascidins, duocarmycin/CC-1065, and bleomycin/pepleomycin.

In other embodiments, the drug can comprise an alkylating agent such as Asaley NSC 167780, AZQ NSC 182986, BCNU NSC 409962, Busulfan NSC 750, carboxyphthalatoplatinum NSC 271674, CBDCA NSC 241240, CCNU NSC 79037, CHIP NSC 256927, chlorambucil NSC 3088, chlorozotocin NSC 178248, cis-platinum NSC 119875, clomesone NSC 338947, cyanomorpholinodoxorubicin NSC 357704, cyclodisone NSC 348948, dianhydrogalactitol NSC 132313, fluorodopan NSC 73754, hepsulfam NSC 329680, hycanthone NSC 142982, melphalan NSC 8806, methyl CCNU NSC 95441, mitomycin C NSC 26980, mitozolamide NSC 353451, nitrogen mustard NSC 762, PCNU NSC 95466, piperazine NSC 344007, piperazinedione NSC 135758, pipobroman NSC 25154, porfiromycin NSC 56410, spirohydantoin mustard NSC 172112, teroxirone NSC 296934, tetraplatin NSC 363812, thio-tepa NSC 6396, triethylenemelamine NSC 9706, uracil nitrogen mustard NSC 34462, or Yoshi-864 NSC 102627.

In some embodiments, the drug can comprise an antimitotic agent such as allocolchicine NSC 406042, Halichondrin B NSC 609395, colchicine NSC 757, colchicine derivative NSC 33410, dolastatin 10 NSC 376128 (NG—auristatin derived), maytansine NSC 153858, rhizoxin NSC 332598, taxol NSC 125973, taxol derivative NSC 608832, thiocolchicine NSC 361792, trityl cysteine NSC 83265, vinblastine sulfate NSC 49842, or vincristine sulfate NSC 67574.

In other embodiments, the drug can comprise an topoisomerase I inhibitor such as camptothecin NSC 94600, camptothecin, Na salt NSC 100880, aminocamptothecin NSC 603071, camptothecin derivative NSC 95382, camptothecin derivative NSC 107124, camptothecin derivative NSC 643833, camptothecin derivative NSC 629971, camptothecin derivative NSC 295500, camptothecin derivative NSC 249910, camptothecin derivative NSC 606985, camptothecin derivative NSC 374028, camptothecin derivative NSC 176323, camptothecin derivative NSC 295501, camptothecin derivative NSC 606172, camptothecin derivative NSC 606173, camptothecin derivative NSC 610458, camptothecin derivative NSC 618939, camptothecin derivative NSC 610457, camptothecin derivative NSC 610459, camptothecin derivative NSC 606499, camptothecin derivative NSC 610456, camptothecin derivative NSC 364830, camptothecin derivative NSC 606497, or morpholinodoxorubicin NSC 354646.

In other embodiments, the drug can comprise an topoisomerase II inhibitor such as doxorubicin NSC 123127, amonafide NSC 308847, m-AMSA NSC 249992, anthrapyrazole derivative NSC 355644, pyrazoloacridine NSC 366140, bisantrene HCL NSC 337766, daunorubicin NSC 82151, deoxydoxorubicin NSC 267469, mitoxantrone NSC 301739, menogaril NSC 269148, N,N-dibenzyl daunomycin NSC 268242, oxanthrazole NSC 349174, rubidazone NSC 164011, VM-26 NSC 122819, or VP-16 NSC 141540.

In other embodiments, the drug can comprise an RNA or DNA antimetabolite such as L-alanosine NSC 153353, 5-azacytidine NSC 102816, 5-fluorouracil NSC 19893, acivicin NSC 163501, aminopterin derivative NSC 132483, aminopterin derivative NSC 184692, aminopterin derivative NSC 134033, an antifol NSC 633713, an antifol NSC 623017, Baker's soluble antifol NSC 139105, dichlorallyl lawsone NSC 126771, brequinar NSC 368390, ftorafur (pro-drug) NSC 148958, 5,6-dihydro-5-azacytidine NSC 264880, methotrexate NSC 740, methotrexate derivative NSC 174121, N-(phosphonoacetyl)-L-aspartate (PALA) NSC 224131, pyrazofurin NSC 143095, trimetrexate NSC 352122, 3-HP NSC 95678, 2'-deoxy-5-fluorouridine NSC 27640, 5-HP NSC 107392, alpha-TGDR NSC 71851, aphidicolin glycinate NSC 303812, ara-C NSC 63878, 5-aza-2'-deoxycytidine NSC 127716, beta-TGDR NSC 71261, cyclocytidine NSC 145668, guanazole NSC 1895, hydroxyurea NSC 32065, inosine glycodialdehyde NSC 118994, macbecin 11 NSC 330500, pyrazoloimidazole NSC 51143, thioguanine NSC 752, or thiopurine NSC 755. See also US 2007-0292441.

The abbreviation "AFP" refers to dimethylvaline-valine-dolaisoleuine-dolaproine-phenylalanine-p-phenylenediamine (e.g., see Formula XVI in US 2006-0233794).

The abbreviation "MAE" refers to monomethyl auristatin E (see Formula XI in US 2006-0233794).

The abbreviation "AEB" refers to an ester produced by reacting auristatin E with paraacetyl benzoic acid (e.g., see Formula XX in US 2006-0233794)

The abbreviation "AEVB" refers to an ester produced by reacting auristatin E with benzoylvaleric acid (e.g., see Formula XXI in US 2006-0233794).

The abbreviation "MMAF" refers to dovaline-valine-dolaisoleuine-dolaproine-phenylalanine (e.g., see Formula IVIV in US 2006-0233794).

The abbreviations "fk" and "phe-lys" refer to the linker phenylalanine-lysine.

The abbreviations "vc" and "val-cit" refer to the linker valine-citrulline.

In some embodiments, the drug is a cytotoxic agent selected from the group consisting of an auristatin, a DNA minor groove binding agent, a DNA minor groove alkylating agent, an enediyne, a lexitropsin, a duocarmycin, a taxane, a puromycin, a dolastatin, a maytansinoid, and a vinca alkaloid.

In some embodiments, the drug is a cytotoxic agent such as AFP or MMAF.

In some embodiments, the drug is an immunosuppressive agent such as gancyclovir, etanercept, cyclosporine, tacrolimus, rapamycin, cyclophosphamide, azathioprine, mycophenolate mofetil, methotrexate, cortisol, aldosterone, dexamethasone, a cyclooxygenase inhibitor, a 5-lipoxygenase inhibitor, or a leukotriene receptor antagonist.

See generally US 2007-0292441; US 2007-0292422; US 2007-0264266; and US 2006-0233794.

Linkers

The binding proteins described herein can be associated with a drug to form a binding protein-drug conjugate by being linked to the drug directly. In some embodiments, the binding protein is directly conjugated to the drug. Alternatively, the binding proteins described herein can be associated with a drug to form a binding protein-drug conjugate by use of a linker region between the drug and the binding protein. In some embodiments, the binding protein is conjugated to the drug via a linker. The linker can be cleavable under intracellular conditions, e.g., such that cleavage of the linker releases the drug from the binding protein in the intracellular environment. In some embodiments, the cleavable linker is a peptide linker cleavable by an intracellular protease. In some embodiments, the peptide linker is a dipeptide linker.

In some embodiments, the dipeptide linker is a val-cit (vc) linker or a phe-lys (fk) linker. In some embodiments, the cleavable linker is hydrolyzable at a pH of less than 5.5. In some embodiments, the hydrolyzable linker is a hydrazone linker. In some embodiments, the cleavable linker is a disulfide linker.

For example, in some embodiments, the linker is cleavable by a cleaving agent that is present in the intracellular environment (e.g., within a lysosome or endosome or caveolea). The linker can be, e.g., a peptidyl linker that is cleaved by an intracellular peptidase or protease enzyme, including, but not limited to, a lysosomal or endosomal protease. In some embodiments, the peptidyl linker is at least two amino acids long or at least three amino acids long. Cleaving agents can include cathepsins B and D and plasmin, which are known to hydrolyze dipeptide drug derivatives resulting in the release of active drug inside target cells (see, e.g., Dubowchik and Walker *Pharm. Therapeutics* 83:67-123 (1999)). In some embodiments, peptidyl linkers are cleavable by enzymes that are present in targeted cells (e.g., cancer cells). For example, a peptidyl linker that is cleavable by the thiol-dependent protease cathepsin-B, which is highly expressed in cancerous tissue, can be used (e.g., a Phe-Leu or a Gly-Phe-Leu-Gly linker). Other such linkers are described, e.g., in U.S. Pat. No. 6,214,345. In some embodiments, the peptidyl linker cleavable by an intracellular protease is a Val-Cit (vc) linker or a Phe-Lys linker (fk) (see, e.g., U.S. Pat. No. 6,214,345, which describes the synthesis of doxorubicin with the val-cit linker). One advantage of using intracellular proteolytic release of the drug is that the drug can be attenuated when conjugated and the serum stabilities of the conjugates are typically high.

In some preferred embodiments, a vc linker is used in the binding protein-drug conjugates described herein. For example, a binding protein-vcAFP or a binding protein-vcMMAF conjugate (e.g., a MMP-12 binding protein-vcAFP or a MMP-12 binding protein-vcMMAF conjugate) is prepared.

In other embodiments, the cleavable linker is pH-sensitive, i.e., sensitive to hydrolysis at certain pH values. For example, the pH-sensitive linker is hydrolyzable under acidic conditions. For example, an acid-labile linker that is hydrolyzable in the lysosome (e.g., a hydrazone, semicarbazone, thiosemicarbazone, cis-aconitic amide, orthoester, acetal., ketal., or the like) can be used. See, e.g., U.S. Pat. Nos. 5,122,368; 5,824,805; 5,622,929; Dubowchik and Walker *Pharm. Therapeutics* 83:67-123 (1999); Neville et al. *Biol. Chem.* 264:14653-14661 (1989). Such linkers are relatively stable under neutral pH conditions, such as those in the blood, but are unstable at below pH 5.5 or 5.0, the approximate pH of the lysosome. In certain embodiments, the hydrolyzable linker is a thioether linker (such as, e.g., a thioether attached to the therapeutic agent via an acylhydrazone bond (see, e.g., U.S. Pat. No. 5,622,929)).

In yet other embodiments, the linker is cleavable under reducing conditions (e.g., a disulfide linker). A variety of disulfide linkers are known in the art, including, for example, those that can be formed using SATA (N-succinimidyl-5-acetylthioacetate), SPDP (N-succinimidyl-3-(2-pyridyldithio)propionate), SPDB (N-succinimidyl-3-(2-pyridyldithio)butyrate) and SMPT (N-succinimidyl-oxycarbonyl-alpha-methyl-alpha-(2-pyridyl-dithio)toluene)-, SPDB and SMPT (See, e.g., Thorpe et al. *Cancer Res.* 47:5924-5931 (1987); Wawrzynczak et al., In Immunoconjugates: Antibody Conjugates in Radioimagery and Therapy of Cancer (C. W. Vogel ed., Oxford U. Press, 1987). See also U.S. Pat. No. 4,880,935.

In yet other embodiments, the linker is a malonate linker (Johnson et al. *Anticancer Res.* 15:1387-93 (1995)), a maleimidobenzoyl linker (Lau et al. *Bioorg-Med-Chem.* 3(10): 1299-1304 (1995), or a 3'-N-amide analog (Lau et al. *Bioorg-Med-Chem.* 3(10):1305-12 (1995)).

In some embodiments, the linker is not substantially sensitive to the extracellular environment. As used herein, "not substantially sensitive to the extracellular environment," in the context of a linker, means that no more than about 20%, typically no more than about 15%, more typically no more than about 10%, and even more typically no more than about 5%, no more than about 3%, or no more than about 1% of the linkers, in a sample of a binding protein-drug conjugate, are cleaved when the binding protein-drug conjugate is present in an extracellular environment (e.g., in plasma). Whether a linker is not substantially sensitive to the extracellular environment can be determined, for example, by incubating independently with plasma both (a) the binding protein-drug conjugate (the "conjugate sample") and (b) an equal molar amount of unconjugated binding protein or drug (the "control sample") for a predetermined time period (e.g., 2, 4, 8, 16, or 24 hours) and then comparing the amount of unconjugated binding protein or drug present in the conjugate sample with that present in control sample, as measured, for example, by high performance liquid chromatography.

In other, non-mutually exclusive embodiments, the linker promotes cellular internalization. In certain embodiments, the linker promotes cellular internalization when conjugated to the drug (i.e., in the milieu of the linker-drug moiety of the binding protein-drug conjugate described herein). In yet other embodiments, the linker promotes cellular internalization when conjugated to both the drug and the binding protein.

A variety of linkers that can be used with the present compositions and methods are described in WO 2004010957.

In some embodiments, the binding protein-drug conjugates described herein are used therapeutically in the treatment of a disorder (e.g., cancer or inflammation). In certain embodiments, it is desirable to only target a binding protein-drug conjugate to a cell that expresses the target to which the binding protein binds (e.g., to only target a MMP-12 expressing cell to which a MMP-12 binding protein binds, and not target a nearby "bystander" cell), e.g., to minimize toxicity. In other embodiments, it is desirable to target a binding protein-drug conjugate to a cell expressing the target to which the binding protein binds and also to bystander cells (e.g., to elicit a "bystander effect"). In some embodiments, a binding protein-drug conjugate (e.g., a MMP-12 binding protein-drug conjugate can be engineered to exert a precise killing of only antigen-presenting cells without damaging proximal antigen-negative tissues, e.g., by preparing thioether-linked conjugates. Alternatively, it can be engineered to produce a bystander effect, e.g., by preparing disulfide-linked conjugates.

For example, many solid tumors express targets (e.g., antigens) in a heterogeneous fashion and are populated with both target-positive and target-negative cells. The bystander cytotoxicity associated with disulfide linker-containing conjugates provides a rationale for treatment of sites of a disorder (e.g., tumors) with binding protein-drug conjugates even if the sites exhibit heterogeneous target expression. The bystander effect adds a degree of nonselective killing activity. Potentially, this could be a drawback if normal cells in tissues surrounding the site of disorder (e.g., tumor) are affected. However, as a potential advantage, the bystander cytotoxicity may damage tissues intricately involved in supporting the disorder, such as endothelial cells and pericytes of tumor neovasculature, or tumor stromal cells, resulting, for example, in enhanced antitumor activity of the binding protein-drug conjugate against tumors expressing the antigen either homogeneously or heterogeneously. See also Kovtum et al. *Cancer Res.* 66:3214 (2006).

Techniques for conjugating therapeutic agents to proteins (such as binding proteins, e.g., MMP-12 binding proteins) are known. See, e.g., Amon et al., "Monoclonal Antibodies For Immunotargeting Of Drugs In Cancer Therapy," in Monoclonal Antibodies And Cancer Therapy (Reisfeld et al eds., Alan R. Liss, Inc., 1985); Hellstrom et al., "Antibodies For Drug Delivery," in Controlled Drug Delivery (Robinson et al. eds., Marcel Deiker, Inc., 2nd ed. 1987); Thorpe, "Antibody Carriers Of Cytotoxic Agents In Cancer Therapy: A Review," in Monoclonal Antibodies '84: Biological And Clinical Applications (Pinchera et al. eds., 1985); "Analysis, Results, and Future Prospective of the Therapeutic Use of Radiolabeled Antibody In Cancer Therapy," in Monoclonal Antibodies For Cancer Detection And Therapy (Baldwin et al. eds., Academic Press, 1985); and Thorpe et al. *Immunol. Rev.* 62:119-58 (1982). See also, e.g., US 2006-0233794 and PCT publication WO 89/12624.

Display Libraries

A display library is a collection of entities; each entity includes an accessible polypeptide component and a recoverable component that encodes or identifies the polypeptide component. The polypeptide component is varied so that different amino acid sequences are represented. The polypeptide component can be of any length, e.g. from three amino acids to over 300 amino acids. A display library entity can include more than one polypeptide component, for example, the two polypeptide chains of a sFab. In one exemplary implementation, a display library can be used to identify proteins that bind to MMP-12. In a selection, the polypeptide component of each member of the library is probed with MMP-12 (e.g., the catalytic domain of MMP-12 or other fragment) and if the polypeptide component binds to the MMP-12, the display library member is identified, typically by retention on a support.

Retained display library members are recovered from the support and analyzed. The analysis can include amplification and a subsequent selection under similar or dissimilar conditions. For example, positive and negative selections can be alternated. The analysis can also include determining the amino acid sequence of the polypeptide component and purification of the polypeptide component for detailed characterization.

A variety of formats can be used for display libraries. Examples include the following.

Phage Display: The protein component is typically covalently linked to a bacteriophage coat protein. The linkage results from translation of a nucleic acid encoding the protein component fused to the coat protein. The linkage can include a flexible peptide linker, a protease site, or an amino acid incorporated as a result of suppression of a stop codon. Phage display is described, for example, in U.S. Pat. No. 5,223,409; Smith (1985) *Science* 228:1315-1317; WO 92/18619; WO 91/17271; WO 92/20791; WO 92/15679; WO 93/01288; WO 92/01047; WO 92/09690; WO 90/02809; de Haard et al. (1999) *J. Biol. Chem.* 274:18218-30; Hoogenboom et al. (1998) *Immunotechnology* 4:1-20; Hoogenboom et al. (2000) *Immunol Today* 2:371-8 and Hoet et al. (2005) *Nat. Biotechnol.* 23(3)344-8. Bacteriophage displaying the protein component can be grown and harvested using standard phage preparatory methods, e.g. PEG precipitation from growth media. After selection of individual display phages, the nucleic acid encoding the selected protein components can be isolated from cells infected with the selected phages or from the phage themselves, after amplification. Individual colonies or plaques can be picked, the nucleic acid isolated and sequenced.

Other Display Formats. Other display formats include cell based display (see, e.g., WO 03/029456), protein-nucleic acid fusions (see, e.g., U.S. Pat. No. 6,207,446), ribosome display (See, e.g., Mattheakis et al. (1994) *Proc. Natl. Acad. Sci. USA* 91:9022 and Hanes et al. (2000) *Nat. Biotechnol.* 18:1287-92; Hanes et al. (2000) *Methods Enzymol.* 328:404-30; and Schaffitzel et al. (1999) *J Immunol Methods.* 231(1-2):119-35), and *E. coli* periplasmic display (*J Immunol Methods.* 2005 Nov. 22; PMID: 16337958).

Scaffolds. Scaffolds useful for display include: antibodies (e.g., Fab fragments, single chain Fv molecules (scFV), single domain antibodies, camelid antibodies, and camelized antibodies); T-cell receptors; MHC proteins; extracellular domains (e.g., fibronectin Type III repeats, EGF repeats); protease inhibitors (e.g., Kunitz domains, ecotin, BPTI, and so forth); TPR repeats; trifoil structures; zinc finger domains; DNA-binding proteins; particularly monomeric DNA binding proteins; RNA binding proteins; enzymes, e.g., proteases (particularly inactivated proteases), RNase; chaperones, e.g., thioredoxin and heat shock proteins; intracellular signaling domains (such as SH2 and SH3 domains); linear and constrained peptides; and linear peptide substrates. Display libraries can include synthetic and/or natural diversity. See, e.g., US 2004-0005709.

Display technology can also be used to obtain binding proteins (e.g., antibodies) that bind particular epitopes of a target. This can be done, for example, by using competing non-target molecules that lack the particular epitope or are mutated within the epitope, e.g., with alanine. Such non-target molecules can be used in a negative selection procedure as described below, as competing molecules when binding a display library to the target, or as a pre-elution agent, e.g., to capture in a wash solution dissociating display library members that are not specific to the target.

Iterative Selection. In one preferred embodiment, display library technology is used in an iterative mode. A first display library is used to identify one or more binding proteins for a target. These identified binding proteins are then varied using a mutagenesis method to form a second display library. Higher affinity binding proteins are then selected from the second library, e.g., by using higher stringency or more competitive binding and washing conditions.

In some implementations, the mutagenesis is targeted to regions at the binding interface. If, for example, the identified binding proteins are antibodies, then mutagenesis can be directed to the CDR regions of the heavy or light chains as described herein. Further, mutagenesis can be directed to framework regions near or adjacent to the CDRs. In the case of antibodies, mutagenesis can also be limited to one or a few of the CDRs, e.g., to make precise step-wise improvements. Exemplary mutagenesis techniques include: error-prone PCR, recombination, DNA shuffling, site-directed mutagenesis and cassette mutagenesis.

In one example of iterative selection, the methods described herein are used to first identify a protein from a display library that binds MMP-12 with at least a minimal binding specificity for a target or a minimal activity, e.g., an equilibrium dissociation constant for binding of less than 1 nM, 10 nM, or 100 nM. The nucleic acid sequence encoding the initial identified proteins are used as a template nucleic acid for the introduction of variations, e.g., to identify a second protein that has enhanced properties (e.g., binding affinity, kinetics, or stability) relative to the initial protein.

Off-Rate Selection. Since a slow dissociation rate can be predictive of high affinity, particularly with respect to interactions between polypeptides and their targets, the methods described herein can be used to isolate binding proteins with a desired (e.g., reduced) kinetic dissociation rate for a binding interaction to a target.

To select for slow dissociating binding proteins from a display library, the library is contacted to an immobilized target. The immobilized target is then washed with a first solution that removes non-specifically or weakly bound biomolecules. Then the bound binding proteins are eluted with a second solution that includes a saturating amount of free target or a target specific high-affinity competing monoclonal antibody, i.e., replicates of the target that are not attached to the particle. The free target binds to biomolecules that dissociate from the target. Rebinding is effectively prevented by the saturating amount of free target relative to the much lower concentration of immobilized target.

The second solution can have solution conditions that are substantially physiological or that are stringent. Typically, the solution conditions of the second solution are identical to the solution conditions of the first solution. Fractions of the second solution are collected in temporal order to distinguish early from late fractions. Later fractions include biomolecules that dissociate at a slower rate from the target than biomolecules in the early fractions.

Further, it is also possible to recover display library members that remain bound to the target even after extended incubation. These can either be dissociated using chaotropic conditions or can be amplified while attached to the target. For example, phage bound to the target can be contacted to bacterial cells.

Selecting or Screening for Specificity. The display library screening methods described herein can include a selection or screening process that discards display library members that bind to a non-target molecule. Examples of non-target molecules include streptavidin on magnetic beads, blocking agents such as bovine serum albumin, non-fat bovine milk, any capturing or target immobilizing monoclonal antibody, or non-transfected cells which do not express the human MMP-12 target.

In one implementation, a so-called "negative selection" step is used to discriminate between the target and related non-target molecule and a related, but distinct non-target molecules. The display library or a pool thereof is contacted to the non-target molecule. Members of the sample that do not bind the non-target are collected and used in subsequent selections for binding to the target molecule or even for subsequent negative selections. The negative selection step can be prior to or after selecting library members that bind to the target molecule.

In another implementation, a screening step is used. After display library members are isolated for binding to the target molecule, each isolated library member is tested for its ability to bind to a non-target molecule (e.g., a non-target listed above). For example, a high-throughput ELISA screen can be used to obtain this data. The ELISA screen can also be used to obtain quantitative data for binding of each library member to the target as well as for cross species reactivity to related targets or subunits of the target (e.g., mouse MMP-12) and also under different condition such as pH6 or pH 7.5. The non-target and target binding data are compared (e.g., using a computer and software) to identify library members that specifically bind to the target.

Other Exemplary Expression Libraries

Other types of collections of proteins (e.g., expression libraries) can be used to identify proteins with a particular property (e.g., ability to bind MMP-12 and/or ability to modulate MMP-12), including, e.g., protein arrays of antibodies (see, e.g., De Wildt et al. (2000) Nat. Biotechnol. 18:989-994), lambda gt11 libraries, two-hybrid libraries and so forth.

Exemplary Libraries

It is possible to immunize a non-human primate and recover primate antibody genes that can be displayed on phage (see below). From such a library, one can select antibodies that bind the antigen used in immunization. See, for example, Vaccine. (2003) 22(2):257-67 or Immunogenetics. (2005) 57(10):730-8. Thus one could obtain primate antibodies that bind and inhibit MMP-9 by immunizing a chimpanzee or macaque and using a variety of means to select or screen for primate antibodies that bind and inhibit MMP-12. One can also make chimeras of primatized Fabs with human constant regions, see Curr Opin Mol Ther. (2004) 6(6):675-83. "PRIMATIZED antibodies, genetically engineered from cynomolgus macaque monkey and human components, are structurally indistinguishable from human antibodies. They may, therefore, be less likely to cause adverse reactions in humans, making them potentially suited for long-term, chronic treatment" Curr Opin Investig Drugs. (2001) 2(5): 635-8.

One exemplary type of library presents a diverse pool of polypeptides, each of which includes an immunoglobulin domain, e.g., an immunoglobulin variable domain. Of interest are display libraries where the members of the library include primate or "primatized" (e.g., such as human, non-human primate or "humanized") immunoglobin domains (e.g., immunoglobin variable domains) or chimeric primatized Fabs with human constant regions. Human or humanized immunoglobin domain libraries may be used to identify human or "humanized" antibodies that, for example, recognize human antigens. Because the constant and framework regions of the antibody are human, these antibodies may avoid themselves being recognized and targeted as antigens when administered to humans. The constant regions may also be optimized to recruit effector functions of the human immune system. The in vitro display selection process surmounts the inability of a normal human immune system to generate antibodies against self-antigens.

A typical antibody display library displays a polypeptide that includes a VH domain and a VL domain. An "immunoglobulin domain" refers to a domain from the variable or constant domain of immunoglobulin molecules. Immunoglobulin domains typically contain two β-sheets formed of about seven β-strands, and a conserved disulphide bond (see, e.g., A. F. Williams and A. N. Barclay, 1988, *Ann. Rev. Immunol.* 6:381-405). The display library can display the antibody as a Fab fragment (e.g., using two polypeptide chains) or a single chain Fv (e.g., using a single polypeptide chain). Other formats can also be used.

As in the case of the Fab and other formats, the displayed antibody can include one or more constant regions as part of a light and/or heavy chain. In one embodiment, each chain includes one constant region, e.g., as in the case of a Fab. In other embodiments, additional constant regions are displayed.

Antibody libraries can be constructed by a number of processes (see, e.g., de Haard et al., 1999, *J. Biol. Chem.* 274: 18218-30; Hoogenboom et al., 1998, *Immunotechnology* 4:1-20; Hoogenboom et al., 2000, *Immunol. Today* 21:371-378, and Hoet et al. (2005) *Nat. Biotechnol.* 23(3)344-8. Further, elements of each process can be combined with those of other processes. The processes can be used such that variation is introduced into a single immunoglobulin domain (e.g., VH or VL) or into multiple immunoglobulin domains (e.g., VH and VL). The variation can be introduced into an immunoglobulin variable domain, e.g., in the region of one or more of CDR1, CDR2, CDR3, FR1, FR2, FR3, and FR4, referring to such regions of either and both of heavy and light chain variable domains. The variation(s) may be introduced into all three CDRs of a given variable domain, or into CDR1 and CDR2, e.g., of a heavy chain variable domain. Any combination is feasible. In one process, antibody libraries are constructed by inserting diverse oligonucleotides that encode CDRs into the corresponding regions of the nucleic acid. The oligonucleotides can be synthesized using monomeric nucleotides or trinucleotides. For example, Knappik et al., 2000, *J. Mol. Biol.* 296:57-86 describe a method for constructing CDR encoding oligonucleotides using trinucleotide synthesis and a template with engineered restriction sites for accepting the oligonucleotides.

In another process, an animal, e.g., a rodent, is immunized with MMP-12. The animal is optionally boosted with the antigen to further stimulate the response. Then spleen cells are isolated from the animal, and nucleic acid encoding VH and/or VL domains is amplified and cloned for expression in the display library.

In yet another process, antibody libraries are constructed from nucleic acid amplified from naïve germline immunoglobulin genes. The amplified nucleic acid includes nucleic acid encoding the VH and/or VL domain. Sources of immunoglobulin-encoding nucleic acids are described below. Amplification can include PCR, e.g., with primers that anneal to the conserved constant region, or another amplification method.

Nucleic acid encoding immunoglobulin domains can be obtained from the immune cells of, e.g., a primate (e.g., a human), mouse, rabbit, camel, or rodent. In one example, the cells are selected for a particular property. B cells at various stages of maturity can be selected. In another example, the B cells are naïve.

In one embodiment, fluorescent-activated cell sorting (FACS) is used to sort B cells that express surface-bound IgM, IgD, or IgG molecules. Further, B cells expressing different isotypes of IgG can be isolated. In another preferred embodiment, the B or T cell is cultured in vitro. The cells can be stimulated in vitro, e.g., by culturing with feeder cells or by adding mitogens or other modulatory reagents, such as antibodies to CD40, CD40 ligand or CD20, phorbol myristate acetate, bacterial lipopolysaccharide, concanavalin A, phytohemagglutinin, or pokeweed mitogen.

In another embodiment, the cells are isolated from a subject that has a disease of condition described herein, e.g., a cancer (e.g., metastatic cancer, e.g., metastatic breast cancer), an inflammatory disease (e.g., synovitis, atherosclerosis), rheumatoid arthritis, osteoarthritis, an ocular condition (e.g., macular degeneration), diabetes, Alzheimer's Disease, cerebral ischemia, endometriosis, fibrin-invasive activity, angiogenesis, or capillary tube formation In another embodiment, the cells are isolated from a transgenic non-human animal that includes a human immunoglobulin locus.

In one preferred embodiment, the cells have activated a program of somatic hypermutation. Cells can be stimulated to undergo somatic mutagenesis of immunoglobulin genes, for example, by treatment with anti-immunoglobulin, anti-CD40, and anti-CD38 antibodies (see, e.g., Bergthorsdottir et al., 2001, *J. Immunol.* 166:2228). In another embodiment, the cells are naïve.

The nucleic acid encoding an immunoglobulin variable domain can be isolated from a natural repertoire by the following exemplary method. First, RNA is isolated from the immune cell. Full length (i.e., capped) mRNAs are separated (e.g. by degrading uncapped RNAs with calf intestinal phosphatase). The cap is then removed with tobacco acid pyrophosphatase and reverse transcription is used to produce the cDNAs.

The reverse transcription of the first (antisense) strand can be done in any manner with any suitable primer. See, e.g., de Haard et al., 1999, *J. Biol. Chem.* 274:18218-30. The primer binding region can be constant among different immunoglobulins, e.g., in order to reverse transcribe different isotypes of immunoglobulin. The primer binding region can also be specific to a particular isotype of immunoglobulin. Typically, the primer is specific for a region that is 3' to a sequence encoding at least one CDR. In another embodiment, poly-dT primers may be used (and may be preferred for the heavy-chain genes).

A synthetic sequence can be ligated to the 3' end of the reverse transcribed strand. The synthetic sequence can be used as a primer binding site for binding of the forward primer during PCR amplification after reverse transcription. The use of the synthetic sequence can obviate the need to use a pool of different forward primers to fully capture the available diversity.

The variable domain-encoding gene is then amplified, e.g., using one or more rounds. If multiple rounds are used, nested primers can be used for increased fidelity. The amplified nucleic acid is then cloned into a display library vector.

Secondary Screening Methods

After selecting candidate library members that bind to a target, each candidate library member can be further analyzed, e.g., to further characterize its binding properties for the target, e.g., MMP-12, or for binding to other protein, e.g., another metalloproteinase. Each candidate library member can be subjected to one or more secondary screening assays. The assay can be for a binding property, a catalytic property, an inhibitory property, a physiological property (e.g., cytotoxicity, renal clearance, immunogenicity), a structural property (e.g., stability, conformation, oligomerization state) or another functional property. The same assay can be used repeatedly, but with varying conditions, e.g., to determine pH, ionic, or thermal sensitivities.

As appropriate, the assays can use a display library member directly, a recombinant polypeptide produced from the nucleic acid encoding the selected polypeptide, or a synthetic peptide synthesized based on the sequence of the selected polypeptide. In the case of selected Fabs, the Fabs can be evaluated or can be modified and produced as intact IgG proteins. Exemplary assays for binding properties include the following.

ELISA. Binding proteins can be evaluated using an ELISA assay. For example, each protein is contacted to a microtitre plate whose bottom surface has been coated with the target, e.g., a limiting amount of the target. The plate is washed with buffer to remove non-specifically bound polypeptides. Then the amount of the binding protein bound to the target on the plate is determined by probing the plate with an antibody that can recognize the binding protein, e.g., a tag or constant portion of the binding protein. The antibody is linked to a detection system (e.g., an enzyme such as alkaline phosphatase or horse radish peroxidase (HRP) which produces a colorimetric product when appropriate substrates are provided).

Homogeneous Binding Assays. The ability of a binding protein described herein to bind a target can be analyzed using a homogenous assay, i.e., after all components of the assay are added, additional fluid manipulations are not required. For example, fluorescence resonance energy transfer (FRET) can be used as a homogenous assay (see, for example, Lakowicz et al., U.S. Pat. No. 5,631,169; Stavrianopoulos, et al., U.S. Pat. No. 4,868,103). A fluorophore label on the first molecule (e.g., the molecule identified in the fraction) is selected such that its emitted fluorescent energy can be absorbed by a fluorescent label on a second molecule (e.g., the target) if the second molecule is in proximity to the first molecule. The fluorescent label on the second molecule fluoresces when it absorbs to the transferred energy. Since the efficiency of energy transfer between the labels is related to the distance separating the molecules, the spatial relationship between the molecules can be assessed. In a situation in which binding occurs between the molecules, the fluorescent emission of the 'acceptor' molecule label in the assay should be maximal. A binding event that is configured for monitoring by FRET can be conveniently measured through standard fluorometric detection means, e.g., using a fluorimeter. By titrating the amount of the first or second binding molecule, a binding curve can be generated to estimate the equilibrium binding constant.

Another example of a homogenous assay is ALPHAS-CREEN™ (Packard Bioscience, Meriden Conn.). ALPHAS-CREEN™ uses two labeled beads. One bead generates singlet oxygen when excited by a laser. The other bead generates a light signal when singlet oxygen diffuses from the first bead and collides with it. The signal is only generated when the two beads are in proximity. One bead can be attached to the display library member, the other to the target. Signals are measured to determine the extent of binding.

Surface Plasmon Resonance (SPR). The interaction of binding protein and a target can be analyzed using SPR. SPR or Biomolecular Interaction Analysis (BIA) detects biospecific interactions in real time, without labeling any of the interactants. Changes in the mass at the binding surface (indicative of a binding event) of the BIA chip result in alterations of the refractive index of light near the surface (the optical phenomenon of surface plasmon resonance (SPR)). The changes in the refractivity generate a detectable signal, which are measured as an indication of real-time reactions between biological molecules. Methods for using SPR are described, for example, in U.S. Pat. No. 5,641,640; Raether, 1988, Surface Plasmons Springer Verlag; Sjolander and Urbaniczky, 1991, *Anal. Chem.* 63:2338-2345; Szabo et al., 1995, *Curr. Opin. Struct. Biol.* 5:699-705 and on-line resources provide by BIAcore International AB (Uppsala, Sweden). BIAcore Flexchip can be used to compare and rank interactions in real time, in terms of kinetics, affinity or specificity without the use of labels.

Information from SPR can be used to provide an accurate and quantitative measure of the equilibrium dissociation constant ($K_d$), and kinetic parameters, including $K_{on}$ and $K_{off}$, for the binding of a binding protein to a target. Such data can be used to compare different biomolecules. For example, selected proteins from an expression library can be compared to identify proteins that have high affinity for the target or that have a slow $K_{off}$. This information can also be used to develop structure-activity relationships (SAR). For example, the kinetic and equilibrium binding parameters of matured versions of a parent protein can be compared to the parameters of the parent protein. Variant amino acids at given positions can be identified that correlate with particular binding parameters, e.g., high affinity and slow $K_{off}$. This information can be combined with structural modeling (e.g., using homology modeling, energy minimization, or structure determination by x-ray crystallography or NMR). As a result, an understanding of the physical interaction between the protein and its target can be formulated and used to guide other design processes.

Cellular Assays. Binding proteins can be screened for ability to bind to cells which transiently or stably express and display the target of interest on the cell surface. For example, MMP-12 binding proteins can be fluorescently labeled and binding to MMP-12 in the presence of absence of antagonistic antibody can be detected by a change in fluorescence intensity using flow cytometry e.g., a FACS machine.

Other Exemplary Methods for Obtaining MMP-12 Binding Antibodies

In addition to the use of display libraries, other methods can be used to obtain a MMP-12 binding antibody. For example, MMP-12 protein or a region thereof can be used as an antigen in a non-human animal, e.g., a rodent.

In one embodiment, the non-human animal includes at least a part of a human immunoglobulin gene. For example, it is possible to engineer mouse strains deficient in mouse antibody production with large fragments of the human Ig loci. Using the hybridoma technology, antigen-specific monoclonal antibodies (Mabs) derived from the genes with the desired specificity may be produced and selected. See, e.g., XENOMOUSE™, Green et al., 1994, *Nat. Gen.* 7:13-21; U.S. 2003-0070185, WO 96/34096, published Oct. 31, 1996, and PCT Application No. PCT/US96/05928, filed Apr. 29, 1996.

In another embodiment, a monoclonal antibody is obtained from the non-human animal, and then modified, e.g., humanized or deimmunized. Winter describes a CDR-grafting method that may be used to prepare the humanized antibodies (UK Patent Application GB 2188638A, filed on Mar. 26, 1987; U.S. Pat. No. 5,225,539. All of the CDRs of a particular human antibody may be replaced with at least a portion of a non-human CDR or only some of the CDRs may be replaced with non-human CDRs. It is only necessary to replace the number of CDRs required for binding of the humanized antibody to a predetermined antigen.

Humanized antibodies can be generated by replacing sequences of the Fv variable region that are not directly involved in antigen binding with equivalent sequences from human Fv variable regions. General methods for generating humanized antibodies are provided by Morrison, S. L., 1985, *Science* 229:1202-1207, by Oi et al., 1986, *BioTechniques* 4:214, and by Queen et al. U.S. Pat. Nos. 5,585,089, U.S. Pat. No. 5,693,761 and U.S. Pat. No. 5,693,762. Those methods include isolating, manipulating, and expressing the nucleic acid sequences that encode all or part of immunoglobulin Fv variable regions from at least one of a heavy or light chain. Numerous sources of such nucleic acid are available. For example, nucleic acids may be obtained from a hybridoma producing an antibody against a predetermined target, as described above. The recombinant DNA encoding the humanized antibody, or fragment thereof, can then be cloned into an appropriate expression vector.

Reducing Immunogenicity of MMP-12 Binding Proteins

Immunoglobin MMP-12 binding proteins (e.g., IgG or Fab MMP-12 binding proteins) may be modified to reduce immunogenicity. Reduced immunogenicity is desirable in MMP-12 binding proteins intended for use as therapeutics, as it reduces the chance that the subject will develop an immune response against the therapeutic molecule. Techniques useful for reducing immunogenicity of MMP-12 binding proteins include deletion/modification of potential human T cell epitopes and 'germlining' of sequences outside of the CDRs (e.g., framework and Fc).

An MMP-12-binding antibody may be modified by specific deletion of human T cell epitopes or "deimmunization" by the methods disclosed in WO 98/52976 and WO 00/34317. Briefly, the heavy and light chain variable regions of an antibody are analyzed for peptides that bind to MHC Class II; these peptides represent potential T-cell epitopes (as defined in WO 98/52976 and WO 00/34317). For detection of potential T-cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T-cell epitopes detected can be eliminated by substituting small numbers of amino acid residues in the variable regions, or preferably, by single amino acid substitutions. As far as possible conservative substitutions are made, often but not exclusively, an amino acid common at this position in human germline antibody sequences may be used. Human germline sequences are disclosed in Tomlinson, I. A. et al., 1992, *J. Mol. Biol.* 227:776-798; Cook, G. P. et al., 1995, *Immunol. Today* Vol. 16 (5): 237-242; Chothia, D. et al., 1992, *J. Mol. Bio.* 227:799-817. The V BASE directory provides a comprehensive directory of human immunoglobulin variable region sequences (compiled by Tomlinson, I. A. et al. MRC Centre for Protein Engineering, Cambridge, UK). After the deimmunizing changes are identified, nucleic acids encoding $V_H$ and $V_L$ can be constructed by mutagenesis or other synthetic methods (e.g., de novo synthesis, cassette replacement, and so forth). Mutagenized variable sequence can, optionally, be fused to a human constant region, e.g., human IgG1 or κ constant regions.

In some cases a potential T cell epitope will include residues which are known or predicted to be important for antibody function. For example, potential T cell epitopes are usually biased towards the CDRs. In addition, potential T cell epitopes can occur in framework residues important for antibody structure and binding. Changes to eliminate these potential epitopes will in some cases require more scrutiny, e.g., by making and testing chains with and without the change. Where possible, potential T cell epitopes that overlap the CDRs were eliminated by substitutions outside the CDRs. In some cases, an alteration within a CDR is the only option, and thus variants with and without this substitution should be tested. In other cases, the substitution required to remove a potential T cell epitope is at a residue position within the framework that might be critical for antibody binding. In these cases, variants with and without this substitution should be tested. Thus, in some cases several variant deimmunized heavy and light chain variable regions were designed and various heavy/light chain combinations tested in order to identify the optimal deimmunized antibody. The choice of the final deimmunized antibody can then be made by considering the binding affinity of the different variants in conjunction with the extent of deimmunization, i.e., the number of potential T cell epitopes remaining in the variable region. Deimmunization can be used to modify any antibody, e.g., an antibody that includes a non-human sequence, e.g., a synthetic antibody, a murine antibody other non-human monoclonal antibody, or an antibody isolated from a display library.

MMP-12 binding antibodies are "germlined" by reverting one or more non-germline amino acids in framework regions to corresponding germline amino acids of the antibody, so long as binding properties are substantially retained. Similar methods can also be used in the constant region, e.g., in constant immunoglobulin domains.

Antibodies that bind to MMP-12, e.g., an antibody described herein, may be modified in order to make the variable regions of the antibody more similar to one or more germline sequences. For example, an antibody can include one, two, three, or more amino acid substitutions, e.g., in a framework, CDR, or constant region, to make it more similar to a reference germline sequence. One exemplary germlining method can include identifying one or more germline sequences that are similar (e.g., most similar in a particular database) to the sequence of the isolated antibody. Mutations (at the amino acid level) are then made in the isolated antibody, either incrementally or in combination with other mutations. For example, a nucleic acid library that includes sequences encoding some or all possible germline mutations is made. The mutated antibodies are then evaluated, e.g., to identify an antibody that has one or more additional germline residues relative to the isolated antibody and that is still useful (e.g., has a functional activity). In one embodiment, as many germline residues are introduced into an isolated antibody as possible.

In one embodiment, mutagenesis is used to substitute or insert one or more germline residues into a framework and/or constant region. For example, a germline framework and/or constant region residue can be from a germline sequence that is similar (e.g., most similar) to the non-variable region being modified. After mutagenesis, activity (e.g., binding or other functional activity) of the antibody can be evaluated to determine if the germline residue or residues are tolerated (i.e., do not abrogate activity). Similar mutagenesis can be performed in the framework regions.

Selecting a germline sequence can be performed in different ways. For example, a germline sequence can be selected if it meets a predetermined criteria for selectivity or similarity, e.g., at least a certain percentage identity, e.g., at least 75, 80, 85, 90, 91, 92, 93, 94, 95, 96, 97, 98, 99, or 99.5% identity. The selection can be performed using at least 2, 3, 5, or 10 germline sequences. In the case of CDR1 and CDR2, identifying a similar germline sequence can include selecting one such sequence. In the case of CDR3, identifying a similar germline sequence can include selecting one such sequence, but may including using two germline sequences that separately contribute to the amino-terminal portion and the carboxy-terminal portion. In other implementations more than one or two germline sequences are used, e.g., to form a consensus sequence.

In one embodiment, with respect to a particular reference variable domain sequence, e.g., a sequence described herein, a related variable domain sequence has at least 30, 40, 50, 60, 70, 80, 90, 95 or 100% of the CDR amino acid positions that are not identical to residues in the reference CDR sequences, residues that are identical to residues at corresponding positions in a human germline sequence (i.e., an amino acid sequence encoded by a human germline nucleic acid).

In one embodiment, with respect to a particular reference variable domain sequence, e.g., a sequence described herein, a related variable domain sequence has at least 30, 50, 60, 70, 80, 85, 90, 91, 92, 93, 94, 95, 96, 97, 98, 99 or 100% of the FR regions identical to FR sequence from a human germline sequence, e.g., a germline sequence related to the reference variable domain sequence.

Accordingly, it is possible to isolate an antibody which has similar activity to a given antibody of interest, but is more similar to one or more germline sequences, particularly one or more human germline sequences. For example, an antibody can be at least 90, 91, 92, 93, 94, 95, 96, 97, 98, 99, or 99.5% identical to a germline sequence in a region outside the CDRs (e.g., framework regions). Further, an antibody can include at least 1, 2, 3, 4, or 5 germline residues in a CDR region, the germline residue being from a germline sequence of similar (e.g., most similar) to the variable region being modified. Germline sequences of primary interest are human germline sequences. The activity of the antibody (e.g., the binding activity as measured by $K_A$) can be within a factor or 100, 10, 5, 2, 0.5, 0.1, and 0.001 of the original antibody.

Germline sequences of human immunoglobin genes have been determined and are available from a number of sources, including the international ImMunoGeneTics Information System® (IMGT), available via the world wide web at imgt-.cines.fr, and the V BASE directory (compiled by Tomlinson, I. A. et al. MRC Centre for Protein Engineering, Cambridge, UK, available via the world wide web at vbase.mrc-cpe.ca-m.ac.uk).

Exemplary germline reference sequences for $V_{kappa}$ include: O12/O2, O18/O8, A20, A30, L14, L1, L15, L4/18a, L5/L19, L8, L23, L9, L24, L11, L12, O11/O1, A17, A1, A18, A2, A19/A3, A23, A27, A11, L2/L16, L6, L20, L25, B3, B2, A26/A10, and A14. See, e.g., Tomlinson et al., 1995, *EMBO J.* 14(18):4628-3.

A germline reference sequence for the HC variable domain can be based on a sequence that has particular canonical structures, e.g., 1-3 structures in the H1 and H2 hypervariable loops. The canonical structures of hypervariable loops of an immunoglobulin variable domain can be inferred from its sequence, as described in Chothia et al., 1992, *J. Mol. Biol.* 227:799-817; Tomlinson et al., 1992, *J. Mol. Biol.* 227:776-798); and Tomlinson et al., 1995, *EMBO J.* 14(18):4628-38. Exemplary sequences with a 1-3 structure include: DP-1, DP-8, DP-12, DP-2, DP-25, DP-15, DP-7, DP-4, DP-31, DP-32, DP-33, DP-35, DP-40, 7-2, hv3005, hv3005f3, DP-46, DP-47, DP-58, DP-49, DP-50, DP-51, DP-53, and DP-54.

Protein Production

Standard recombinant nucleic acid methods can be used to express a protein that binds to MMP-12. Generally, a nucleic acid sequence encoding the protein is cloned into a nucleic acid expression vector. Of course, if the protein includes multiple polypeptide chains, each chain can be cloned into an expression vector, e.g., the same or different vectors, that are expressed in the same or different cells.

Antibody Production. Some antibodies, e.g., Fabs, can be produced in bacterial cells, e.g., *E. coli* cells. For example, if the Fab is encoded by sequences in a phage display vector that includes a suppressible stop codon between the display entity and a bacteriophage protein (or fragment thereof), the vector nucleic acid can be transferred into a bacterial cell that cannot suppress a stop codon. In this case, the Fab is not fused to the gene III protein and is secreted into the periplasm and/or media.

Antibodies can also be produced in eukaryotic cells. In one embodiment, the antibodies (e.g., scFv's) are expressed in a yeast cell such as *Pichia* (see, e.g., Powers et al., 2001, *J. Immunol. Methods.* 251:123-35), *Hanseula*, or *Saccharomyces*.

In one preferred embodiment, antibodies are produced in mammalian cells. Preferred mammalian host cells for expressing the clone antibodies or antigen-binding fragments thereof include Chinese Hamster Ovary (CHO cells) (including dhfr-CHO cells, described in Urlaub and Chasin, 1980, *Proc. Natl. Acad. Sci. USA* 77:4216-4220, used with a DHFR selectable marker, e.g., as described in Kaufman and Sharp, 1982, *Mol. Biol.* 159:601 621), lymphocytic cell lines, e.g., NS0 myeloma cells and SP2 cells, COS cells, HEK293T cells (*J. Immunol. Methods* (2004) 289(1-2):65-80), and a cell from a transgenic animal, e.g., a transgenic mammal. For example, the cell is a mammary epithelial cell.

In addition to the nucleic acid sequence encoding the diversified immunoglobulin domain, the recombinant expression vectors may carry additional sequences, such as sequences that regulate replication of the vector in host cells (e.g., origins of replication) and selectable marker genes. The selectable marker gene facilitates selection of host cells into which the vector has been introduced (see e.g., U.S. Pat. Nos. 4,399, 216, 4,634,665 and 5,179,017). For example, typically the selectable marker gene confers resistance to drugs, such as G418, hygromycin or methotrexate, on a host cell into which the vector has been introduced. Preferred selectable marker genes include the dihydrofolate reductase (DHFR) gene (for use in dhfr⁻ host cells with methotrexate selection/amplification) and the neo gene (for G418 selection).

In an exemplary system for recombinant expression of an antibody, or antigen-binding portion thereof, a recombinant expression vector encoding both the antibody heavy chain and the antibody light chain is introduced into dhfr⁻ CRO cells by calcium phosphate-mediated transfection. Within the recombinant expression vector, the antibody heavy and light chain genes are each operatively linked to enhancer/promoter regulatory elements (e.g., derived from SV40, CMV, adenovirus and the like, such as a CMV enhancer/AdMLP promoter regulatory element or an SV40 enhancer/AdMLP promoter regulatory element) to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the antibody heavy and light chains and intact antibody is recovered from the culture medium. Standard molecular biology techniques are used to prepare the recombinant expression vector, transfect the host cells, select for transformants, culture the host cells and recover the antibody from the culture medium. For example, some antibodies can be isolated by affinity chromatography with a Protein A or Protein G coupled matrix.

For antibodies that include an Fc domain, the antibody production system may produce antibodies in which the Fc region is glycosylated. For example, the Fc domain of IgG molecules is glycosylated at asparagine 297 in the CH2 domain. This asparagine is the site for modification with biantennary-type oligosaccharides. It has been demonstrated that this glycosylation is required for effector functions mediated by Fcg receptors and complement C1q (Burton and Woof, 1992,*Adv. Immunol.* 51:1-84; Jefferis et al., 1998, *Immunol. Rev.* 163:59-76). In one embodiment, the Fc domain is produced in a mammalian expression system that appropriately glycosylates the residue corresponding to asparagine 297. The Fc domain can also include other eukaryotic post-translational modifications.

Antibodies can also be produced by a transgenic animal. For example, U.S. Pat. No. 5,849,992 describes a method of expressing an antibody in the mammary gland of a transgenic mammal. A transgene is constructed that includes a milk-specific promoter and nucleic acids encoding the antibody of interest and a signal sequence for secretion. The milk produced by females of such transgenic mammals includes, secreted-therein, the antibody of interest. The antibody can be purified from the milk, or for some applications, used directly.

Characterization of MMP-12 Binding Proteins

Binding of MMP-12 binding proteins to cells expressing MMP-12 can be characterized in a number assays known in the art, including FACS (Fluorescence Activated Cell Sorting), ELISA, immunofluorescence, and immunocytochemistry. MMP-12 binding protein is contacted with cells and/or tissues which express or contain MMP-12, and binding is detected in accordance with the method being used. For example, a fluorescent detection system (e.g., fluorescent-labeled secondary antibody) employed for FACS and immunofluorescence analysis, or a enzymatic system is used for immunocytochemistry are generally used in these assays can be performed on non-perm. MMP-12 binding proteins can be characterized as to cellular binding by FACS (Fluorescence Activated Cell Sorting) using cells expressing MMP-12. Individual cells held in a thin stream of fluid are passed through one or more laser beams cause light to scatter and fluorescent dyes to emit light at various frequencies. Photomultiplier tubes (PMT) convert light to electrical signals and cell data is collected. Forward and side scatter are used for preliminary identification of cells. Forward and side scatter are used to exclude debris and dead cells. Fluorescent labeling allows investigation of cell structure and function. Cell autofluorescence is generated by labeling cell structures with fluorescent dyes. FACS collects fluorescence signals in one to several channels corresponding to different laser excitation and fluorescence emission wavelength. Immunofluorescence, the most widely used application, involves the staining of cells with antibodies conjugated to fluorescent dyes such as fluorescein and phycoerythrin (PE). This method can be used to label MMP-12 on permeabilized cells, e.g., using biotinylated MMP-12 binding proteins. Biotin is used in this two-step detection systems in concert with conjugated steptavidin. Biotin is typically conjugated to proteins via primary amines (i.e., lysines). Usually, between 1.5 and 3 biotin molecules are conjugated to each antibody. A second fluorescently conjugated antibody (streptavidin/PE) is added which is specific for biotin.

MMP-12 binding proteins can be characterized in cultured cells expressing the MMP-12 antigen. The method generally used is immunocytochemistry. Immunocytochemistry involves the use of antibodies that recognize parts of the protein that are exposed to the outside environment when expressed at the cell surface (the 'primary antibody') or that are accessible upon permeabilization of the cell. If the experiment is carried out in intact cells, such an antibody will only bind to surface expressed receptors. Biotinylated or non-biotinylated MMP-12 binding proteins can be used. The secondary antibody is then either a streptavidin/HRP antibody (for biotinylated MMP-12 binding protein) or an anti-human IgG/HRP (for non-biotinylated MMP-12 binding protein). The staining can then be detected using an inverted microscope. The assay can be performed in the absence of MMP-12 binding protein and in presence of 10 μg/mL of MMP-12 binding protein. Secreted MMP12 can be detected in samples of the medium in which MMP-12-expressing cells are cultured. For example, antibody based screening methods, e.g., using binding proteins described herein, can be used to detect secreted MMP-12. For example, immunoblot analysis or ELISA can be used.

MMP-12 binding proteins can be characterized in assays that measure their modulatory activity toward MMP-12 or fragments thereof in vitro or in vivo. For example, MMP-12 can be combined with a substrate such as Mca-Pro-Leu-Ala-Cys(Mob)-Trp-Ala-Arg-Dap(Dnp)-NH$_2$ (SEQ ID NO: 6) under assay conditions permitting cleavage by MMP-12. The assay is performed in the absence of the MMP-12 binding protein, and in the presence of increasing concentrations of the MMP-12 binding protein. The concentration of binding protein at which 50% of the MMP-12 activity (e.g., binding to the substrate) is inhibited is the IC$_{50}$ value (Inhibitory Concentration 50%) or EC$_{50}$ (Effective Concentration 50%) value for that binding protein. Within a series or group of binding proteins, those having lower IC$_{50}$ or EC$_{50}$ values are considered more potent inhibitors of MMP-12 than those binding proteins having higher IC$_{50}$ or EC$_{50}$ values. Exemplary binding proteins have an IC$_{50}$ value of less than 800 nM, 400 nM, 100 nM, 25 nM, 5 nM, or 1 nM, e.g., as measured in an in vitro assay for inhibition of MMP-12 activity when the MMP-12 is at 2 pM.

MMP-12 binding proteins may also be characterized with reference to the activity of MMP-12 on substrates (e.g., lung extracellular matrix, elastin, gelatin, etc.). For example, cleavage of gelatin by MMP-12 can be detected in zymography. The method is based on a SDS gel impregnated with a substrate, which is degraded by the proteases resolved during the incubation period. Coomassie blue staining of the gels reveals proteolytic fragments as white bands on a dark blue background. Within a certain range, the band intensity can be related linearly to the amount of the protease loaded. Cells expressing MMP-12 are used in this assay. The assay is performed in the absence of the MMP-12 binding protein, and in the presence of increasing concentrations of the MMP-12 binding protein. The concentration of binding protein at which 50% of the MMP-12 activity (e.g., binding to the substrate) is inhibited is the IC$_{50}$ value (Inhibitory Concentration 50%) or EC$_{50}$ (Effective Concentration 50%) value for that binding protein. Within a series or group of binding proteins, those having lower IC$_{50}$ or EC$_{50}$ values are considered more potent inhibitors of MMP-12 than those binding proteins having higher IC$_{50}$ or EC$_{50}$ values. Exemplary binding proteins have an IC$_{50}$ value of less than 800 nM, 400 nM, 100 nM, 25 nM, 5 nM, or 1 nM, e.g., as measured in an in vitro assay for inhibition of MMP-12 activity.

The binding proteins can also be evaluated for selectivity toward MMP-12. For example, a MMP-12 binding protein can be assayed for its potency toward MMP-12 and a panel of MMPs and other enzymes, e.g., human and/or mouse enzymes, e.g., MMP-1, -2, -3, -7, -8, -9, -13, -14, -16, -17, -24, and TACE, and an IC$_{50}$ value or EC$_{50}$ value can be determined for each MMP. In one embodiment, a compound that demonstrates a low IC$_{50}$ value or EC$_{50}$ value for the MMP-12, and a higher IC$_{50}$ value or EC$_{50}$ value, e.g., at least 2-, 5-, or 10-fold higher, for another MMP within the test panel (e.g., MMP-1, -10) is considered to be selective toward MMP-12.

MMP-12 binding proteins can be evaluated for their ability to inhibit MMP-12 in a cell based assay, e.g., in situ zymography, e.g., in Colo205 cells or MCF-7 cells.

A pharmacokinetics study in rat, mice, or monkey can be performed with MMP-12 binding proteins for determining MMP-12 half-life in the serum. Likewise, the effect of the binding protein can be assessed in vivo, e.g., in an animal model for a disease, for use as a therapeutic, for example, to treat a disease or condition described herein, e.g., a cancer (e.g., metastatic cancer, e.g., metastatic colorectal, lung, or hepatocellular cancer), an inflammatory disease (e.g., chronic obstructive pulmonary disease (COPD), asthma, rhinitis (e.g., allergic rhinitis), atherosclerosis, multiple sclerosis, rheumatoid arthritis), cardiovascular disease, aneurysym, wound healing, aging and nerve damage associated with excess or inappropriate activity of MMP-12.

Pharmaceutical Compositions

In another aspect, the disclosure provides compositions, e.g., pharmaceutically acceptable compositions or pharmaceutical compositions, which include an MMP-12-binding protein, e.g., an antibody molecule, other polypeptide or peptide identified as binding to MMP-12 described herein. The MMP-12 binding protein can be formulated together with a pharmaceutically acceptable carrier. Pharmaceutical compositions include therapeutic compositions and diagnostic compositions, e.g., compositions that include labeled MMP-12 binding proteins for in vivo imaging.

A pharmaceutically acceptable carrier includes any and all solvents, dispersion media, coatings, antibacterial and antifungal agents, isotonic and absorption delaying agents, and the like that are physiologically compatible. Preferably, the carrier is suitable for intravenous, intramuscular, subcutaneous, parenteral, spinal, or epidermal administration (e.g., by injection or infusion), although carriers suitable for inhalation and intranasal administration are also contemplated. Depending on the route of administration, the MMP-12 binding protein may be coated in a material to protect the compound from the action of acids and other natural conditions that may inactivate the compound.

A pharmaceutically acceptable salt is a salt that retains the desired biological activity of the parent compound and does not impart any undesired toxicological effects (see e.g., Berge, S. M., et al., 1977, *J. Pharm. Sci.* 66:1-19). Examples of such salts include acid addition salts and base addition salts. Acid addition salts include those derived from nontoxic inorganic acids, such as hydrochloric, nitric, phosphoric, sulfuric, hydrobromic, hydroiodic, phosphorous, and the like, as well as from nontoxic organic acids such as aliphatic mono- and dicarboxylic acids, phenyl-substituted alkanoic acids, hydroxy alkanoic acids, aromatic acids, aliphatic and aromatic sulfonic acids, and the like. Base addition salts include those derived from alkaline earth metals, such as sodium, potassium, magnesium, calcium, and the like, as well as from nontoxic organic amines, such as N,N'-dibenzylethylenediamine, N-methylglucamine, chloroprocaine, choline, diethanolamine, ethylenediamine, procaine, and the like.

The compositions may be in a variety of forms. These include, for example, liquid, semi-solid and solid dosage forms, such as liquid solutions (e.g., injectable and infusible solutions), dispersions or suspensions, tablets, pills, powders, liposomes and suppositories. The form can depend on the intended mode of administration and therapeutic application. Many compositions are in the form of injectable or infusible solutions, such as compositions similar to those used for administration of humans with antibodies. An exemplary mode of administration is parenteral (e.g., intravenous, subcutaneous, intraperitoneal, intramuscular). In one embodiment, the MMP-12 binding protein is administered by intravenous infusion or injection. In another preferred embodiment, the MMP-12 binding protein is administered by intramuscular or subcutaneous injection.

The phrases "parenteral administration" and "administered parenterally" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

The composition can be formulated as a solution, microemulsion, dispersion, liposome, or other ordered structure suitable to high drug concentration. Sterile injectable solutions can be prepared by incorporating the binding protein in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition an agent that delays absorption, for example, monostearate salts and gelatin.

An MMP-12 binding protein can be administered by a variety of methods, although for many applications, the preferred route/mode of administration is intravenous injection or infusion. For example, for therapeutic applications, the MMP-12 binding protein can be administered by intravenous infusion at a rate of less than 30, 20, 10, 5, or 1 mg/min to reach a dose of about 1 to 100 mg/m$^2$ or 7 to 25 mg/m$^2$. The route and/or mode of administration will vary depending upon the desired results. In certain embodiments, the active compound may be prepared with a carrier that will protect the compound against rapid release, such as a controlled release formulation, including implants, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are available. See, e.g., Sustained and Controlled Release Drug Delivery Systems, J. R. Robinson, ed., 1978, Marcel Dekker, Inc., New York.

Pharmaceutical compositions can be administered with medical devices. For example, in one embodiment, a pharmaceutical composition disclosed herein can be administered with a device, e.g., a needleless hypodermic injection device, a pump, or implant.

In certain embodiments, an MMP-12 binding protein can be formulated to ensure proper distribution in vivo. For example, the blood-brain barrier (BBB) excludes many highly hydrophilic compounds. To ensure that the therapeutic compounds disclosed herein cross the BBB (if desired), they can be formulated, for example, in liposomes. For methods of manufacturing liposomes, see, e.g., U.S. Pat. Nos. 4,522,811; 5,374,548; and 5,399,331. The liposomes may comprise one or more moieties that are selectively transported into specific cells or organs, thus enhance targeted drug delivery (see, e.g., V. V. Ranade, 1989, *J. Clin. Pharmacol.* 29:685).

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. The specification for the dosage unit forms can be dictated by and directly dependent on (a) the unique characteristics of the active compound and the particular therapeutic effect to be achieved, and (b) the limitations inherent in the art of compounding such an active compound for the treatment of sensitivity in individuals.

An exemplary, non-limiting range for a therapeutically or prophylactically effective amount of an antibody disclosed herein is 0.1-20 mg/kg, more preferably 1-10 mg/kg. An anti-MMP-12 antibody can be administered, e.g., by intravenous infusion, e.g., at a rate of less than 30, 20, 10, 5, or 1 mg/min to reach a dose of about 1 to 100 mg/m² or about 5 to 30 mg/m². For binding proteins smaller in molecular weight than an antibody, appropriate amounts can be proportionally less. Dosage values may vary with the type and severity of the condition to be alleviated. For a particular subject, specific dosage regimens can be adjusted over time according to the individual need and the professional judgment of the person administering or supervising the administration of the compositions.

The pharmaceutical compositions disclosed herein may include a "therapeutically effective amount" or a "prophylactically effective amount" of an MMP-12 binding protein disclosed herein. A "therapeutically effective amount" refers to an amount effective, at dosages and for periods of time necessary, to achieve the desired therapeutic result. A therapeutically effective amount of the composition may vary according to factors such as the disease state, age, sex, and weight of the individual, and the ability of the protein to elicit a desired response in the individual. A therapeutically effective amount is also one in which any toxic or detrimental effects of the composition is outweighed by the therapeutically beneficial effects.

A "therapeutically effective dosage" preferably modulates a measurable parameter, e.g., levels of circulating IgG antibodies or enzymatic activity, by a statistically significant degree or at least about 20%, more preferably by at least about 40%, even more preferably by at least about 60%, and still more preferably by at least about 80% relative to untreated subjects. The ability of a compound to modulate a measurable parameter, e.g., a disease-associated parameter, can be evaluated in an animal model system predictive of efficacy in human disorders and conditions, e.g., a cancer (e.g., metastatic cancer, e.g., metastatic colorectal, lung, or hepatocellular cancer), an inflammatory disease (e.g., chronic obstructive pulmonary disease (COPD), asthma, rhinitis (e.g., allergic rhinitis), atherosclerosis, multiple sclerosis, rheumatoid arthritis), cardiovascular disease, aneurysym, wound healing, aging and nerve damage associated with excess or inappropriate activity of MMP-12. Alternatively, this property of a composition can be evaluated by examining the ability of the compound to modulate a parameter in vitro.

A "prophylactically effective amount" refers to an amount effective, at dosages and for periods of time necessary, to achieve the desired prophylactic result. Typically, because a prophylactic dose is used in subjects prior to or at an earlier stage of disease, the prophylactically effective amount will be less than the therapeutically effective amount.

Stabilization and Retention

In one embodiment, an MMP-12 binding protein is physically associated with a moiety that improves its stabilization and/or retention in circulation, e.g., in blood, serum, lymph, or other tissues, e.g., by at least 1.5, 2, 5, 10, or 50 fold. For example, an MMP-12 binding protein can be associated with a polymer, e.g., a substantially non-antigenic polymer, such as polyalkylene oxides or polyethylene oxides. Suitable polymers will vary substantially by weight. Polymers having molecular number average weights ranging from about 200 to about 35,000 (or about 1,000 to about 15,000, and 2,000 to about 12,500) can be used. For example, an MMP-12 binding protein can be conjugated to a water soluble polymer, e.g., hydrophilic polyvinyl polymers, e.g. polyvinylalcohol and polyvinylpyrrolidone. A non-limiting list of such polymers include polyalkylene oxide homopolymers such as polyethylene glycol (PEG) or polypropylene glycols, polyoxyethylenated polyols, copolymers thereof and block copolymers thereof, provided that the water solubility of the block copolymers is maintained.

An MMP-12 binding protein can also be associated with a carrier protein, e.g., a serum albumin, such as a human serum albumin. For example, a translational fusion can be used to associate the carrier protein with the MMP-12 binding protein.

Kits

An MMP-12 binding protein described herein can be provided in a kit, e.g., as a component of a kit. For example, the kit includes (a) an MMP-12 binding protein, e.g., a composition that includes an MMP-12 binding protein, and, optionally (b) informational material. The informational material can be descriptive, instructional, marketing or other material that relates to the methods described herein and/or the use of an MMP-12 binding protein for the methods described herein.

The informational material of the kits is not limited in its form. In one embodiment, the informational material can include information about production of the compound, molecular weight of the compound, concentration, date of expiration, batch or production site information, and so forth. In one embodiment, the informational material relates to using the binding protein to treat, prevent, or diagnosis of disorders and conditions, e.g., a cancer (e.g., metastatic cancer, e.g., metastatic colorectal, lung, or hepatocellular cancer), an inflammatory disease (e.g., chronic obstructive pulmonary disease (COPD), asthma, rhinitis (e.g., allergic rhinitis), atherosclerosis, multiple sclerosis, rheumatoid arthritis), cardiovascular disease, aneurysym, wound healing, aging and nerve damage associated with excess or inappropriate activity of MMP-12.

In one embodiment, the informational material can include instructions to administer an MMP-12 binding protein in a suitable manner to perform the methods described herein, e.g., in a suitable dose, dosage form, or mode of administration (e.g., a dose, dosage form, or mode of administration described herein). In another embodiment, the informational material can include instructions to administer an MMP-12 binding protein to a suitable subject, e.g., a human, e.g., a human having, or at risk for, a disorder or condition described herein, e.g., a cancer (e.g., metastatic cancer, e.g., metastatic colorectal, lung, or hepatocellular cancer), an inflammatory disease (e.g., chronic obstructive pulmonary disease (COPD), asthma, rhinitis (e.g., allergic rhinitis), atherosclerosis, multiple sclerosis, rheumatoid arthritis), cardiovascular disease, aneurysym, wound healing, aging and nerve damage associated with excess or inappropriate activity of MMP-12. For example, the material can include instructions to administer an MMP-12 binding protein to a patient with a disorder or condition described herein, e.g., a cancer (e.g., metastatic cancer, e.g., metastatic colorectal, lung, or hepatocellular cancer), an inflammatory disease (e.g., chronic obstructive pulmonary disease (COPD), asthma, rhinitis (e.g., allergic rhinitis), atherosclerosis, multiple sclerosis, rheumatoid arthritis), cardiovascular disease, aneurysym, wound healing, aging and nerve damage associated with excess or inappropriate activity of MMP-12. The informational material of the kits is not limited in its form. In many cases, the informational material, e.g., instructions, is provided in print but may also be in other formats, such as computer readable material.

An MMP-12 binding protein can be provided in any form, e.g., liquid, dried or lyophilized form. It is preferred that an MMP-12 binding protein be substantially pure and/or sterile. When an MMP-12 binding protein is provided in a liquid solution, the liquid solution preferably is an aqueous solution, with a sterile aqueous solution being preferred. When an MMP-9 binding protein is provided as a dried form, reconstitution generally is by the addition of a suitable solvent. The solvent, e.g., sterile water or buffer, can optionally be provided in the kit.

The kit can include one or more containers for the composition containing an MMP-12 binding protein. In some embodiments, the kit contains separate containers, dividers or compartments for the composition and informational material. For example, the composition can be contained in a bottle, vial, or syringe, and the informational material can be contained association with the container. In other embodiments, the separate elements of the kit are contained within a single, undivided container. For example, the composition is contained in a bottle, vial or syringe that has attached thereto the informational material in the form of a label. In some embodiments, the kit includes a plurality (e.g., a pack) of individual containers, each containing one or more unit dosage forms (e.g., a dosage form described herein) of an MMP-12 binding protein. For example, the kit includes a plurality of syringes, ampules, foil packets, or blister packs, each containing a single unit dose of an MMP-12 binding protein. The containers of the kits can be air tight, waterproof (e.g., impermeable to changes in moisture or evaporation), and/or light-tight.

The kit optionally includes a device suitable for administration of the composition, e.g., a syringe, inhalant, dropper (e.g., eye dropper), swab (e.g., a cotton swab or wooden swab), or any such delivery device. In one embodiment, the device is an implantable device that dispenses metered doses of the binding protein. The disclosure also features a method of providing a kit, e.g., by combining components described herein.

Treatments

Proteins that bind to MMP-12 and identified by the method described herein and/or detailed herein have therapeutic and prophylactic utilities, particularly in human subjects. These binding proteins are administered to a subject to treat, prevent, and/or diagnose a variety of disorders, including e.g., a cancer (e.g., metastatic cancer, e.g., metastatic colorectal, lung, or hepatocellular cancer), an inflammatory disease (e.g., chronic obstructive pulmonary disease (COPD), asthma, rhinitis (e.g., allergic rhinitis), atherosclerosis, multiple sclerosis, rheumatoid arthritis), cardiovascular disease, aneurysym, wound healing, aging and nerve damage associated with excess or inappropriate activity of MMP-12, or even to cells in culture, e.g. in vitro or ex vivo. Treating includes administering an amount effective to alleviate, relieve, alter, remedy, ameliorate, improve or affect the disorder, the symptoms of the disorder or the predisposition toward the disorder. The treatment may also delay onset, e.g., prevent onset, or prevent deterioration of a disease or condition.

Exemplary disorders include a cancer (e.g., metastatic cancer, e.g., metastatic lung, colorectal or hepatocellular cancer), an inflammatory disease (e.g., chronic obstructive pulmonary disease (COPD), asthma, rhinitis (e.g., allergic rhinitis), atherosclerosis, multiple sclerosis, rheumatoid arthritis), cardiovascular disease, aneurysym, wound healing, aging and nerve damage associated with excess or inappropriate activity of MMP-12. Some of these disorders are discussed above. Still other disorders that can be treated using an MMP-12 binding protein include: aortic aneurysms, dermal photoaging.

As used herein, an amount of an target-binding agent effective to prevent a disorder, or a prophylactically effective amount of the binding agent refers to an amount of a target binding agent, e.g., an MMP-12 binding protein, e.g., an anti-MMP-12 antibody described herein, which is effective, upon single- or multiple-dose administration to the subject, for preventing or delaying the occurrence of the onset or recurrence of a disorder, e.g., a disorder described herein.

A binding agent described herein can be used to reduce angiogenesis in a subject, e.g., to treat a cancer (e.g., a solid tumor) or an angiogenesis-associated disorder. The method includes administering the binding to the subject, e.g., in an amount effective to modulate angiogenesis, a symptom of the disorder, or progression of the disorder. The agent (e.g., an MMP-12 binding protein, e.g., an anti-MMP-12 antibody) may be administered multiple times (e.g., at least two, three, five, or ten times) before a therapeutically effective amount is attained.

Methods of administering MMP-12 binding proteins and other agents are also described in "Pharmaceutical Compositions." Suitable dosages of the molecules used can depend on the age and weight of the subject and the particular drug used. The binding proteins can be used as competitive agents to inhibit, reduce an undesirable interaction, e.g., between a natural or pathological agent and the MMP-12. The dose of the MMP-12 binding protein can be the amount sufficient to block 90%, 95%, 99%, or 99.9% of the activity of MMP-12 in the patient, especially at the site of disease. Depending on the disease, this may require 0.1, 1.0, 3.0, 6.0, or 10.0 mg/Kg. For an IgG having a molecular mass of 150,000 g/mole (two binding sites), these doses correspond to approximately 18 nM, 180 nM, 540 nM, 1.08 µM, and 1.8 µM of binding sites for a 5 L blood volume.

In one embodiment, the MMP-12 binding proteins are used to inhibit an activity (e.g., inhibit at least one activity of, reduce proliferation, migration, growth or viability) of a cell, e.g., a cancer cell in vivo. The binding proteins can be used by themselves or conjugated to an agent, e.g., a cytotoxic drug, cytotoxin enzyme, or radioisotope. This method includes: administering the binding protein alone or attached to an agent (e.g., a cytotoxic drug), to a subject requiring such treatment. For example, MMP-12 binding proteins that do not substantially inhibit MMP-12 may be used to deliver nanoparticles containing agents, such as toxins, to MMP-12 associated cells or tissues, e.g., tumors.

Because the MMP-12 binding proteins recognize MMP-12-expressing cells and can bind to cells that are associated with (e.g., in proximity of or intermingled with) cancer cells, e.g., cancerous lung, liver, colon, breast, ovarian, epidermal, laryngeal, and cartilage cells, and particularly metastatic cells thereof, MMP-12 binding proteins can be used to inhibit (e.g., inhibit at least one activity, reduce growth and proliferation, or kill) any such cells and inhibit carcinogenesis. Reducing MMP-12 activity near a cancer can indirectly inhibit (e.g., inhibit at least one activity, reduce growth and proliferation, or kill) the cancer cells which may be dependent on the MMP-12 activity for metastasis, activation of growth factors, and so forth.

Alternatively, the binding proteins bind to cells in the vicinity of the cancerous cells, but are sufficiently close to the cancerous cells to directly or indirectly inhibit (e.g., inhibit at least one activity, reduce growth and proliferation, or kill) the cancers cells. Thus, the MMP-12 binding proteins (e.g., modified with a toxin, e.g., a cytotoxin) can be used to selectively inhibit cells in cancerous tissue (including the cancerous cells themselves and cells associated with or invading the cancer).

The binding proteins may be used to deliver an agent (e.g., any of a variety of cytotoxic and therapeutic drugs) to cells and tissues where MMP-12 is present. Exemplary agents include a compound emitting radiation, molecules of plants, fungal, or bacterial origin, biological proteins, and mixtures thereof. The cytotoxic drugs can be intracellularly acting cytotoxic drugs, such as toxins short range radiation emitters, e.g., short range, high energy α-emitters.

To target MMP-12 expressing cells, particularly cancerous cells, a prodrug system can be used. For example, a first binding protein is conjugated with a prodrug which is activated only when in close proximity with a prodrug activator. The prodrug activator is conjugated with a second binding protein, preferably one which binds to a non competing site on the target molecule. Whether two binding proteins bind to competing or non competing binding sites can be determined by conventional competitive binding assays. Exemplary drug prodrug pairs are described in Blakely et al., (1996) Cancer Research, 56:3287 3292.

The MMP-12 binding proteins can be used directly in vivo to eliminate antigen-expressing cells via natural complement-dependent cytotoxicity (CDC) or antibody dependent cellular cytotoxicity (ADCC). The binding proteins described herein can include complement binding effector domain, such as the Fc portions from IgG1, -2, or -3 or corresponding portions of IgM which bind complement. In one embodiment, a population of target cells is ex vivo treated with a binding agent described herein and appropriate effector cells. The treatment can be supplemented by the addition of complement or serum containing complement. Further, phagocytosis of target cells coated with a binding protein described herein can be improved by binding of complement proteins. In another embodiment target, cells coated with the binding protein which includes a complement binding effector domain are lysed by complement.

Methods of administering MMP-12 binding proteins are described in "Pharmaceutical Compositions." Suitable dosages of the molecules used will depend on the age and weight of the subject and the particular drug used. The binding proteins can be used as competitive agents to inhibit or reduce an undesirable interaction, e.g., between a natural or pathological agent and the MMP-12.

The MMP-12 binding protein can be used to deliver macro and micromolecules, e.g., a gene into the cell for gene therapy purposes into the endothelium or epithelium and target only those tissues expressing the MMP-12. The binding proteins may be used to deliver a variety of cytotoxic drugs including therapeutic drugs, a compound emitting radiation, molecules of plants, fungal, or bacterial origin, biological proteins, and mixtures thereof. The cytotoxic drugs can be intracellularly acting cytotoxic drugs, such as short range radiation emitters, including, for example, short range, high energy α emitters, as described herein.

In the case of polypeptide toxins, recombinant nucleic acid techniques can be used to construct a nucleic acid that encodes the binding protein (e.g., antibody or antigen-binding fragment thereof) and the cytotoxin (or a polypeptide component thereof) as translational fusions. The recombinant nucleic acid is then expressed, e.g., in cells and the encoded fusion polypeptide isolated.

Alternatively, the MMP-12 binding protein can be coupled to high energy radiation emitters, for example, a radioisotope, such as $^{131}$I, a γ-emitter, which, when localized at a site, results in a killing of several cell diameters. See, e.g., S.E. Order, "Analysis, Results, and Future Prospective of the Therapeutic Use of Radiolabeled Antibody in Cancer Therapy", *Monoclonal Antibodies for Cancer Detection and Therapy*, R. W. Baldwin et al. (eds.), pp 303 316 (Academic Press 1985). Other suitable radioisotopes include a emitters, such as $^{212}$Bi, $^{213}$Bi, and $^{211}$At, and b emitters, such as $^{186}$Re and $^{90}$Y. Moreover, $^{177}$Lu may also be used as both an imaging and cytotoxic agent.

Radioimmunotherapy (RIT) using antibodies labeled with $^{131}$I, $^{90}$Y, and $^{177}$Lu is under intense clinical investigation. There are significant differences in the physical characteristics of these three nuclides and as a result, the choice of radionuclide is very critical in order to deliver maximum radiation dose to a tissue of interest. The higher beta energy particles of $^{90}$Y may be good for bulky tumors. The relatively low energy beta particles of $^{131}$I are ideal, but in vivo dehalogenation of radioiodinated molecules is a major disadvantage for internalizing antibody. In contrast, $^{177}$Lu has low energy beta particle with only 0.2-0.3 mm range and delivers much lower radiation dose to bone marrow compared to $^{90}$Y. In addition, due to longer physical half-life (compared to $^{90}$Y), the residence times are higher. As a result, higher activities (more mCi amounts) of $^{177}$Lu labeled agents can be administered with comparatively less radiation dose to marrow. There have been several clinical studies investigating the use of $^{177}$Lu labeled antibodies in the treatment of various cancers. (Mulligan T et al., 1995, *Clin. Canc. Res.* 1: 1447-1454; Meredith R F, et al., 1996, *J. Nucl. Med.* 37:1491-1496; Alvarez R D, et al., 1997, *Gynecol. Oncol.* 65: 94-101).

Exemplary Diseases and Conditions

The MMP-12 binding proteins described herein are useful to treat diseases or conditions in which MMP-12 is implicated, e.g., a disease or condition described herein, or to treat one or more symptoms associated therewith. In some embodiments, the MMP-12 binding protein (e.g., MMP-12 binding IgG or Fab) inhibits MMP-12 activity, e.g., catalytic activity.

Examples of such diseases and conditions include a cancer (e.g., metastatic cancer, e.g., metastatic colorectal, lung, or hepatocellular cancer), an inflammatory disease (e.g., chronic obstructive pulmonary disease (COPD), asthma, rhinitis (e.g., allergic rhinitis), atherosclerosis, multiple sclerosis, rheumatoid arthritis), cardiovascular disease, aneurysym, wound healing, aging and nerve damage associated with excess or inappropriate activity of MMP-12. A therapeutically effective amount of a MMP-12 binding protein is administered to a subject having or suspected of having a disorder in which MMP-12 is implicated, thereby treating (e.g., ameliorating or improving a symptom or feature of a disorder, slowing, stabilizing or halting disease progression) the disorder.

The MMP-12 binding protein is administered in a therapeutically effective amount. A therapeutically effective amount of an MMP-12 binding protein is the amount which is effective, upon single or multiple dose administration to a subject, in treating a subject, e.g., curing, alleviating, relieving or improving at least one symptom of a disorder in a subject to a degree beyond that expected in the absence of such treatment. A therapeutically effective amount of the composition may vary according to factors such as the disease state, age, sex, and weight of the individual, and the ability of the compound to elicit a desired response in the individual. A therapeutically effective amount is also one in which any toxic or detrimental effects of the composition are outweighed by the therapeutically beneficial effects.

A therapeutically effective amount can be administered, typically an amount of the compound which is effective, upon single or multiple dose administration to a subject, in treating a subject, e.g., curing, alleviating, relieving or improving at least one symptom of a disorder in a subject to a degree beyond that expected in the absence of such treatment. A therapeutically effective amount of the composition may vary according to factors such as the disease state, age, sex, and weight of the individual, and the ability of the compound to elicit a desired response in the individual. A therapeutically effective amount is also one in which any toxic or detrimental effects of the composition are outweighed by the therapeutically beneficial effects. A therapeutically effective dosage preferably modulates a measurable parameter, favorably, relative to untreated subjects. The ability of a compound to inhibit a measurable parameter can be evaluated in an animal model system predictive of efficacy in a human disorder.

Dosage regimens can be adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

Cancer

Matrix metalloproteases (MMPs), such as MMP-12, are believed to contribute to cancer by cleaving components of the ECM and basement membranes, thereby allowing cancer cells to penetrate and infiltrate the subjacent stromal matrix. Additionally, a number of growth-factor receptors, cell adhesion molecules, chemokines, cytokines, apoptotic ligands, and angiogenic factors are substrates of MMPs. Hence, MMP activity may cause activation of growth factors, suppression of tumor cell apoptosis, destruction of chemokine gradients developed by host immune response, or release of angiogenic factors. MMPs may facilitate tumor growth by promoting the release of cell proliferation factors such as insulin-like growth factors which are bound to specific binding proteins (IG-FBPs) (Manes et al., 1997 J. Biol. Chem. 272: 25706-25712).

Collagenases, including MMP-12, have been found at elevated levels in cancers of the colon, lung, and liver. Usually, these elevated levels correlate with higher tumor grade and invasiveness.

Accordingly, the disclosure provides methods of treating (e.g., slowing, eliminating, or reversing tumor growth, preventing or reducing, either in number or size, metastases, reducing or eliminating tumor cell invasiveness, providing an increased interval to tumor progression, or increasing disease-free survival time) cancer (e.g., breast cancer, including Her2+, Her2−, ER+, ER−, Her2+/ER+, Her2+/ER−, Her2−/ER+, and Her2−/ER− breast cancer), head and neck cancer, oral cavity cancer, laryngeal cancer, chondrosarcoma, ovarian cancer, lung cancer (e.g., non-small cell lung cancer), prostate cancer, colon cancer, colorectal cancer, liver cancer (hepatcellular cancer), cervical cancer, testicular carcinoma, melanoma, brain tumors (e.g., astrocytomas, glioblastomas, gliomas)) by administering an effective amount of an MMP-12 binding protein (e.g., an anti-MMP-12 IgG or Fab). In some embodiments, the MMP-12 binding protein inhibits MMP-12 activity.

In certain embodiments, the MMP-12 binding protein is administered as a single agent treatment. In other embodiments, the MMP-12 binding protein is administered in combination with an additional anti-cancer agent.

Also provided are methods of preventing or reducing risk of developing cancer, by administering an effective amount of an MMP-12 binding protein to a subject at risk of developing cancer, thereby reducing the subject's risk of developing a cancer.

The disclosure further provides methods of modulating (e.g., reducing or preventing) angiogenesis at a tumor site by administering an effective amount of an MMP-12 binding protein, thereby reducing or preventing angiogenesis at the tumor site. The MMP-12 binding protein may be administered as a single agent therapy or in combination with additional agents.

Also provided are methods for reducing extracellular matrix (ECM) degradation by a tumor, comprising administering an effective amount of an MMP-12 binding protein to a subject, thereby reducing ECM degradation by a tumor in the subject.

The disclosed methods are useful in the prevention and treatment of solid tumors, soft tissue tumors, and metastases thereof. Solid tumors include malignancies (e.g., sarcomas, adenocarcinomas, and carcinomas) of the various organ systems, such as those of lung, breast, lymphoid, gastrointestinal (e.g., colon), and genitourinary (e.g., renal, urothelial, or testicular tumors) tracts, pharynx, prostate, and ovary. Exemplary adenocarcinomas include colorectal cancers, renal-cell carcinoma, liver cancer, non-small cell carcinoma of the lung, and cancer of the small intestine. Additional exemplary solid tumors include: fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, gastrointestinal system carcinomas, colon carcinoma, pancreatic cancer, breast cancer, genitourinary system carcinomas, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, endocrine system carcinomas, testicular tumor, lung carcinoma, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, and retinoblastoma. Metastases of the aforementioned cancers can also be treated or prevented in accordance with the methods described herein.

Guidance for determination of a therapeutically effective amount for treatment of cancer may be obtained by reference to in vivo models of the cancer to be treated. For example, the amount of a MMP-12 binding protein that is a therapeutically effective amount in a rodent or Libechov minipig model of cancer may be used to guide the selection of a dose that is a therapeutically effective amount. A number of rodent models of human cancers are available, including nude mouse/tumor xenograft systems (e.g., melanoma xenografts; see, e.g., Trikha et al. Cancer Research 62:2824-2833 (2002)) and murine models of breast cancer or glioma (e.g., Kuperwasser et al., Cancer Research 65, 6130-6138, (2005); Bradford et al., Br J. Neurosurg. 3(2):197-210 (1989)). A melanoblastoma-bearing Libechov minipig (MeLiM) is available as an animal model of melanoma (e.g., Boisgard et al., Eur J Nucl Med Mol Imaging 30(6):826-34 (2003)).

Rheumatoid Arthritis and Associated Conditions

Rheumatoid arthritis (RA) is an autoimmune, chronic inflammatory disease that causes joint swelling and pain and normally results in joint destruction. RA generally follows a relapsing/remitting course, with "flares" of disease activity interspersed with remissions of disease symptoms. RA is associated with a number of additional inflammatory disorders, including Sjogren's syndrome (dry eyes and mouth caused by inflammation of tear and saliva glands), pleuritis (inflammation of the pleura that causes pain upon deep breath and coughing), rheumatoid nodules (nodular sites of inflammation that develop within the lungs), pericarditis (inflammation of the pericardium that causes pain when lying down or leaning forward), Felty syndrome (splenomegaly and leucopenia observed in conjunction with RA, making the subject prone to infection), and vasculitis (an inflammation of the blood vessels which can block blood flow). MMP-12 has been implicated in rheumatoid arthritis.

Symptoms of active RA include fatigue, lack of appetite, low grade fever, muscle and joint aches, and stiffness. Muscle and joint stiffness are usually most notable in the morning and after periods of inactivity. During flares, joints frequently become red, swollen, painful, and tender, generally as a consequence of synovitis.

Treatment for rheumatoid arthritis involves a combination of medications, rest, joint strengthening exercises, and joint protection. Two classes of medications are used in treating rheumatoid arthritis: anti-inflammatory "first-line drugs," and Disease-Modifying Antirheumatic Drugs (DMARDs)." The first-line drugs include NSAIDS (e.g., aspirin, naproxen, ibuprofen, and etodolac) and cortisone (corticosteroids). DMARDS, such as gold (e.g., gold salts, gold thioglucose, gold thiomalate, oral gold), methotrexate, sulfasalazine, D-penicillamine, azathioprine, cyclophosphamide, chlorambucil, and cyclosporine, leflunomide, etanercept, infliximab, anakinra, and adalimumab, and hydroxychloroquine, promote disease remission and prevent progressive joint destruction, but they are not anti-inflammatory agents.

Increased levels of MMP-12 have been found in subjects with arthritis (compared with normal individuals). The disclosure provides methods of treating (e.g., ameliorating, stabilizing, or eliminating one or more symptoms or ameliorating or stabilizing the subject's score on a RA scale) rheumatoid arthritis by administering a therapeutically effective amount of a MMP-12 binding protein to a subject having or suspected of having RA. Additionally provides are methods of treating RA by administering a therapeutically effective amount of a MMP-12 binding protein and at least one NSAID and/or DMARDS.

Further provided are methods of treating (e.g., ameliorating, stabilizing, or eliminating one or more symptoms) rheumatoid arthritis associated disorders (Sjogren's syndrome, pleuritis, pulmonary rheumatoid nodules, pericarditis, Felty syndrome, and vasculitis) by administering a therapeutically effective amount of an MMP-12 binding protein.

Scales useful for assessing RA and symptoms of RA include the Rheumatoid Arthritis Severity Scale (RASS; Bardwell et al., (2002) *Rheumatology* 41(1):38-45), SF-36 Arthritis Specific Health Index (ASHI; Ware et al., (1999) *Med. Care.* 37(5 Suppl):MS40-50), Arthritis Impact Measurement Scales or Arthritis Impact Measurement Scales 2 (AIMS or AIMS2; Meenan et al. (1992) *Arthritis Rheum.* 35(1): 1-10); the Stanford Health Assessment Questionnaire (HAQ), HAQII, or modified HAQ (see, e.g., Pincus et al. (1983) *Arthritis Rheum.* 26(11):1346-53).

Guidance for the determination of the dosage that delivers a therapeutically effective amount of a MMP-12 binding protein may be obtained from animal models of rheumatoid arthritis, such as collagen-induced arthritis (CIA), which is induced, typically in rodents, by immunization with autologous or heterologous type II collagen in adjuvant (Williams et al. Methods Mol. Med. 98:207-16 (2004)).

COPD

Chronic Obstructive Pulmonary Disease (COPD), also known as chronic obstructive airway disease (COAD), is a group of diseases characterized by the pathological limitation of airflow in the airway that is not fully reversible. COPD is the umbrella term for chronic bronchitis, emphysema and a range of other lung disorders. It is most often due to tobacco smoking, but can be due to other airborne irritants such as coal dust, asbestos or solvents, as well as congenital conditions such as alpha-1-antitrypsin deficiency.

The main symptoms of COPD include dyspnea (shortness of breath) lasting for months or perhaps years, possibly accompanied by wheezing, and a persistent cough with sputum production. It is possible the sputum may contain blood (hemoptysis) and become thicker, usually due to damage of the blood vessels of the airways. Severe COPD could lead to cyanosis caused by a lack of oxygen in the blood. In extreme cases it could lead to cor pulmonale due to the extra work required by the heart to get blood to flow through the lungs.

COPD is particularly characterised by the spirometric measurement of a ratio of forced expiratory volume over 1 second ($FEV_1$) to forced vital capacity (FVC) being <0.7 and the $FEV_1$<80% of the predicted value as measured by a plethysmograph. Other signs include a rapid breathing rate (tachypnea) and a wheezing sound heard through a stethoscope. Pulmonary emphysema is NOT the same as subcutaneous emphysema, which is a collection of air under the skin that may be detected by the crepitus sounds produced on palpation.

Treatment for COPD includes inhalers that dilate the airways (bronchodilators) and sometimes theophylline. The COPD patient must stop smoking. In some cases inhaled steroids are used to suppress lung inflammation, and, in severe cases or flare-ups, intravenous or oral steroids are given. Antibiotics are used during flare-ups of symptoms as infections can worsen COPD. Chronic, low-flow oxygen, non-invasive ventilation, or intubation may be needed in some cases. Surgery to remove parts of the disease lung has been shown to be helpful for some patients with COPD. Lung rehabilitation programs may help some patients. Lung transplant is sometimes performed for severe cases. Bronchodilators that can be used include:

There are several types of bronchodilators used clinically with varying efficacy: for example, $\beta_2$ agonists, $M_3$ antimuscarinics, leukotriene antagonists, cromones, corticosteroids, and xanthines. These drugs relax the smooth muscles of the airway allowing for improved airflow. $\beta_2$ agonists include: Salbutamol (VENTOLIN®), Bambuterol, Clenbuterol, Fenoterol, and Formoterol, and long acting $\beta_2$ agonists (LABAs) such as Salmeterol. $M_3$ muscarinic antagonists (anticholinergics) include the quaternary $M_3$ muscarinic antagonist Ipratropium, which is widely prescribed with the $\beta_2$ agonist salbutamol, Ipratropium, and Tiotropium, which can be combined with a LABA and inhaled steroid. Cromones include Cromoglicate and Nedocromil. Leukotriene antagonists can be used and include Montelukast, Pranlukast, Zafirlukast. Xanthines include theophylline, methylxanthines, theobromine. More aggressive EMR interventions include IV $H_1$ antihistamines and IV dexamethasone. Phosphodiesterase-4 antagonists inlcude roflumilast and cilomilast. Corticosteroids can be used and include glucocorticoids, beclomethasone, mometasone, and fluticasone. Corticosteroids are often combined with bronchodilators in a single inhaler. Salmeterol and fluticasone can be combined (ADVAIR®). TNF antagonists include cachexin, cachectin infliximab, adalimumab and etanercept.

The disclosure provides methods of treating COPD (e.g., ameliorating symptoms or the worsening of COPD) by administering a therapeutically effective amount of a MMP-12 binding protein (e.g., an inhibitory MMP-12 binding protein, e.g., an anti-MMP-12 IgG or Fab) to a subject having or suspected of having COPD. Also provided are methods of treating COPD by administering a therapeutically effective amount of a MMP-12 binding protein with another COPD treatment (e.g., β2 agonists, $M_3$ antimuscarinics, leukotriene antagonists, cromones, corticosteroids, and xanthines).

Guidance regarding the efficacy and dosage an MMP-12 binding protein which will deliver a therapeutically effective amount of the protein can be obtained from an animal model of COPD, see e.g., PCT publication WO 2007/084486 and references cited therein.

Emphysema

Emphysema is a chronic obstructive pulmonary disease (COPD), formerly termed a chronic obstructive lung disease (COLD). It is often caused by exposure to toxic chemicals or long-term exposure to tobacco smoke.

Emphysema is caused by loss of elasticity (increased compliance) of the lung tissue, from destruction of structures supporting the alveoli, and destruction of capillaries feeding the alveoli, due to the action of alpha 1 antitrypsin deficiency. Thus the small airways collapse during exhalation, although alveolar collapsibility has increased. This impedes airflow and traps air in the lungs, as with other obstructive lung diseases. Symptoms include shortness of breath on exertion and later at rest, hyperventilation, and an expanded chest.

Signs of emphysema include pursed-lipped breathing, central cyanosis and finger clubbing. The chest has increased percussion notes, particularly just above the liver, and a difficult to palpate apex beat, both due to hyperinflation. There may be decreased breath sounds and audible expiratory wheeze. In advanced disease, there are signs of fluid overload such as pitting peripheral edema. The face has a ruddy complexion if there is a secondary polycythemia. Sufferers who retain carbon dioxide have asterixis (metabolic flap) at the wrist.

Emphysema is an irreversible degenerative condition. An important measure to slow its progression is for the patient to stop smoking and avoid all exposure to cigarette smoke and lung irritants. Pulmonary rehabilitation can be very helpful to optimize the patient's quality of life and teach the patient how to actively manage his or her care. Emphysema is also treated by supporting the breathing with anticholinergics, bronchodilators, steroid medication (inhaled or oral), and supplemental oxygen as required. Treating the patient's other conditions including gastric reflux and allergies can improve lung function. Supplemental oxygen used as prescribed (usually more than 20 hours per day) is the only non-surgical treatment which has been shown to prolong life in emphysema patients. Lung volume reduction surgery (LVRS) can improve the quality of life for certain carefully selected patients. Another treatment option is lung transplant, but few patients are strong enough physically to survive the surgery.

Cigarette smoke condensate induces MMP-12 gene expression in airway-like epithelia in mice (Lavigne et al. Biochem biophys Res Commun. 2005: 330:194). COPD patients produce greater quantities of MMP-12 than controls, which may be a critical step in the pathogenesis of emphysema (Molet et al. 2005: Inflamm Res. 2005: 54(1): 31). It has been shown that inflammatory lesions in the lungs of mice contain significantly more MMP-12 in macrophages at 10, 20, and 30 days than in controls of mice exposed to cigarette for 60 days (Valenca et al. Toxicol Pathol. 2004:32(3):351).

The disclosure provides methods of treating or preventing emphysema (e.g., ameliorating symptoms or the worsening of emphysema) by administering a therapeutically effective amount of a MMP-12 binding protein (e.g., an inhibitory MMP-12 binding protein, e.g., an anti-MMP-12 IgG or Fab) to a subject having or suspected of having emphysema. Also provided are methods of treating emphysema by administering a therapeutically effective amount of a MMP-12 binding protein with another emphysema treatment (e.g., anticholinergics, bronchodilators, steroid medication, oxygen supplementation, lung volume reduction surgery or lung transplant).

Guidance regarding the efficacy and dosage an MMP-12 binding protein which will deliver a therapeutically effective amount of the protein can be obtained from animal models of emphysema, see e.g., those described in Molet et al. 2005: Inflamm Res. 2005: 54(1): 31, Valenca et al. Toxicol Pathol. 2004:32(3):351, and references cited therein.

Asthma

Asthma is a chronic condition involving the respiratory system in which the airway occasionally constricts, becomes inflamed, and is lined with excessive amounts of mucus, often in response to one or more triggers. These episodes may be triggered by such things as exposure to an environmental stimulant (or allergen) such as cold air, warm air, moist air, exercise or exertion, or emotional stress. In children, the most common triggers are viral illnesses such as those that cause the common cold. This airway narrowing causes symptoms such as wheezing, shortness of breath, chest tightness, and coughing. The airway constriction responds to bronchodilators.

In some individuals asthma is characterized by chronic respiratory impairment. In others it is an intermittent illness marked by episodic symptoms that may result from a number of triggering events, including upper respiratory infection, stress, airborne allergens, air pollutants (such as smoke or traffic fumes), or exercise. Some or all of the following symptoms may be present in those with asthma: dyspnea, wheezing, stridor, coughing, an inability for physical exertion. Some asthmatics who have severe shortness of breath and tightening of the lungs never wheeze or have stridor and their symptoms may be confused with a COPD-type disease.

An acute exacerbation of asthma is commonly referred to as an asthma attack. The clinical hallmarks of an attack are shortness of breath (dyspnea) and either wheezing or stridor.

During an asthma episode, inflamed airways react to environmental triggers such as smoke, dust, or pollen. The airways narrow and produce excess mucus, making it difficult to breathe. In essence, asthma is the result of an immune response in the bronchial airways.

The airways of asthmatics are "hypersensitive" to certain triggers/stimuli. In response to exposure to these triggers, the bronchi (large airways) contract into spasm (an "asthma attack"). Inflammation soon follows, leading to a further narrowing of the airways and excessive mucus production, which leads to coughing and other breathing difficulties.

The most effective treatment for asthma is identifying triggers, such as pets or aspirin, and limiting or eliminating exposure to them. Desensitization is currently the only known "cure" to the disease.

Symptomatic control of episodes of wheezing and shortness of breath is generally achieved with fast-acting bronchodilators.

Relief medication: Short-acting, selective $beta_2$-adrenoceptor agonists, such as salbutamol (albuterol USAN), levalbuterol, terbutaline and bitolterol, can be used. Older, less selective adrenergic agonists, such as inhaled epinephrine and ephedrine tablets, can be used. Anticholinergic medications, such as ipratropium bromide may be used.

Preventative medication: Current treatment protocols recommend prevention medications such as an inhaled corticosteroid, which helps to suppress inflammation and reduces the swelling of the lining of the airways, in anyone who has frequent (greater than twice a week) need of relievers or who has severe symptoms. If symptoms persist, additional preventive drugs are added until the asthma is controlled. With the proper use of prevention drugs, asthmatics can avoid the complications that result from overuse of relief medications. Preventive agents include: inhaled glucocorticoids (e.g., ciclesonide, beclomethasone, budesonide, flunisolide, fluticasone, mometasone, and triamcinolone), leukotriene modifiers (e.g., montelukast, zafirlukast, pranlukast, and zileuton), mast cell stabilizers (e.g., cromoglicate (cromolyn), and nedocromil), antimuscarinics/anticholinergics (e.g., ipratropium, oxitropium, and tiotropium), methylxanthines (e.g., theophylline and aminophylline), antihistamines, an IgE blocker such as omalizumab, methotrexate).

Long-acting beta$_2$-adrenoceptor agonists can be used and include salmeterol, formoterol, bambuterol, and sustained-release oral albuterol. Combinations of inhaled steroids and long-acting bronchodilators are becoming more widespread; the most common combination currently in use is fluticasone/salmeterol (Advair in the United States, and Seretide in the United Kingdom). Another combination is budesonide/formoterol which is commercially known as Symbicort.

Concentrations of MMP-12 are increased in asthmatic subjects as compared with normal individuals. The disclosure provides methods of treating asthma (e.g., ameliorating symptoms or the worsening of asthma) by administering a therapeutically effective amount of a MMP-12 binding protein (e.g., an inhibitory MMP-12 binding protein, e.g., an anti-MMP-12 IgG or Fab) to a subject having or suspected of having asthma. Also provided are methods of treating asthma by administering a therapeutically effective amount of a MMP-12 binding protein with another asthma treatment (e.g., glucocorticoids, leukotriene modifiers, mast cell stabilizers, antimuscarinics/anticholinergics, antihistamines, an IgE blocker, methotrexate.

Guidance regarding the efficacy and dosage an MMP-12 binding protein which will deliver a therapeutically effective amount of the protein can be obtained from an animal model of asthma, see e.g., U.S. Pat. No. 5,602,302, or European Pat. No. EP1192944 B1, and references cited therein.

Atherosclerosis and Cardiovascular Disease

Atherosclerosis is a disease affecting arterial blood vessels. It is a chronic inflammatory response in the walls of arteries, in large part due to the accumulation of macrophage white blood cells and promoted by low density (especially small particle) lipoproteins (plasma proteins that carry cholesterol and triglycerides) without adequate removal of fats and cholesterol from the macrophages by functional high density lipoproteins (HDL). It is caused by the formation of multiple plaques within the arteries.

Atherosclerosis causes two main problems. First, the atheromatous plaques, though long compensated for by artery enlargement, eventually lead to plaque ruptures and stenosis (narrowing) of the artery and, therefore, an insufficient blood supply to the organ it feeds. If the compensating artery enlargement process is excessive, then an aneurysm results.

Commonly, soft plaque suddenly ruptures, causing the formation of a thrombus that will rapidly slow or stop blood flow, leading to death of the tissues fed by the artery. This event is called an infarction. One commonly recognized scenario is called coronary thrombosis of a coronary artery, causing myocardial infarction (a heart attack). Another common scenario is claudication from insufficient blood supply to the legs, typically due to a combination of both stenosis and aneurysmal segments narrowed with clots. Since atherosclerosis is a body-wide process, similar events also occur in the arteries to the brain, intestines, kidneys, legs, etc.

Atherosclerosis commonly becomes symptomatic when interfering with the coronary circulation supplying the heart or cerebral circulation supplying the brain, and is considered an underlying cause of strokes, heart attacks, various heart diseases including congestive heart failure, and most cardiovascular diseases, in general.

In human peripheral blood derived macrophages, MMP-12 mRNA is upregulated by several pro-atherosclerotic cytokines (Feinberg et al. J Biol. Chem. 2000: 275(33):25766). Transcript levels of MMP-12 in carotid atherosclerotic plaques correlate with histological features and clinical manisfestations (Morgan et al. Stroke. 2004: 35(6): 1310). MMP-12 mRNA was consistently demonstrated in atherosclerotic occlusive disease (AOD) tissues and may have a direct role in the pathogenesis of aortic aneurysms (Curci et al. J Clin Invest. 1998:102(11):1900). Epidemiological data and in vivo animal experiments have indicated that differentiation of macrophages into potentially plaque-forming foam cells accompanied significantly elevated levels of matrix-degrading MMP-12 (Vogel et al. Cardiovasc Toxicol. 2004:4(4): 363). MMP-12 has been shown to play an important role in vascular stenosis in hypercholesterolemia in hypercholesterolemic hamsters (Matsuno et al. 2004: 44(1): 57). Deficiency in MMP-12 protected apolipoprotein E-deficient mice against atherosclerotic media destruction when MMP-12 deficiency mice were crossed in the atherosclerosis-prone apoliprotein E-deficient background and fed a cholesterol-rich diet (Lutten et al. 2004: 109(11): 1408).

Smoking has been shown to be associated with increased macrophage immunoreactivity as well as elevated expression of MMP-12, which is a marker of inflammation and tissue destruction atherosclerotic plaques (Kangavari et al. J Cardiovasc Pharmacol Ther. 2004: 9(4):291). MMP-12 was detected in the lungs of rats treated with intraperitoneal nicotine and might play an important role in the development of cardiovascular and lung diseases in smokers (Valenca et al. Exp Toxicol Pathol. 2004: 55(5)393).

Treatment for atherosclerosis includes statins, primary and secondary prevention, diet and dietary supplements, surgical intervention and prophylaxis.

Some statins, e.g., rosuvastatin, have demonstrated regression of atherosclerotic plaque within the coronary arteries by IVUS (intravascular ultrasound evaluation). Combinations of statins, niacin, intestinal cholesterol absorption-inhibiting supplements (ezetimibe and others, and to a much lesser extent fibrates) have been a successful in changing common but sub-optimal lipoprotein patterns and group outcomes.

In addition, several classes of lipoprotein expression altering agents have consistently reduced not only heart attack, stroke and hospitalization but also mortality rates. Vitamin B3, AKA niacin, in pharmacologic doses, (generally 1,000 to 3,000 mg/day) tend to improve (a) HDL levels, size and function; (b) shift LDL particle distribution to larger particle size; and (c) lower lipoprotein (a), an atheroslerosis promoting genetic variant of LDL. The described MMP-12 binding proteins can be administered in combination with one or more of these treatments.

Other treatments include minimally invasive angioplasty procedures that can include stents to physically expand narrowed arteries, and major invasive surgery, such as bypass surgery, to create additional blood supply connections that go around the more severely narrowed areas.

Patients at risk for atherosclerosis-related diseases are increasingly being treated prophylactically with low-dose aspirin and a statin.

The disclosure provides methods of treating or preventing atherosclerosis and cardiovascular disease (e.g., ameliorating symptoms or the worsening of atherosclerosis and cardiovascular disease) by administering a therapeutically effective amount of a MMP-12 binding protein (e.g., an inhibitory MMP-12 binding protein, e.g., an anti-MMP-12 IgG or Fab) to a subject having or suspected of having atherosclerosis and cardiovascular disease. Also provided are methods of treating atherosclerosis and cardiovascular disease by administering a therapeutically effective amount of a MMP-12 binding protein with another atherosclerosis and cardiovascular disease treatment (e.g., statins, primary and secondary prevention, diet and dietary supplements, surgical intervention or prophylaxis)

Guidance regarding the efficacy and dosage an MMP-12 binding protein which will deliver a therapeutically effective amount of the protein can be obtained from animal models of atherosclerosis, see e.g., those described in Fan et al. Transgenic Res. 2004: 13(3): 261) and references cited therein.

Multiple Sclerosis

Multiple sclerosis (MS) is an autoimmune condition in which the immune system attacks the central nervous system (CNS), leading to demyelination. It may cause numerous physical and mental symptoms, and often progresses to physical and cognitive disability. Disease onset usually occurs in young adults, is more common in women.

MS presents with a variety of symptoms, including changes in sensation (hypoesthesia); muscle weakness, abnormal muscle spasms, or difficulty in moving; difficulties with coordination and balance (ataxia); problems in speech (dysarthria) or swallowing (dysphagia); visual problems (nystagmus, optic neuritis, or diplopia); fatigue and acute or chronic pain syndromes; and bladder and bowel difficulties. Cognitive impairment of varying degrees, or emotional symptomatology in the form of depression or pseudobulbar affect are also common. Neuropathic pain is usual, and this can be in the form of Lhermitte's sign. Paraesthesias can be present and include pins and needles; tingling; shivering; burning pains; feelings of pressure; and areas of skin with heightened sensitivity to touch. The pains associated with these can be aching, throbbing, stabbing, shooting, gnawing, tingling, tightness and numbness. The main clinical measure of disability progression and severity of the symptoms is the Expanded Disability Status Scale or EDSS.

The initial attacks (also known as exacerbations or relapses) are often transient, mild (or asymptomatic), and self-limited. The common initial symptoms reported are: changes in sensation in the arms, legs or face (33%), complete or partial vision loss (optic neuritis) (16%), weakness (13%), double vision (7%), unsteadiness when walking (5%), and balance problems (3%); but many rare initial symptoms have been reported such as aphasia or psychosis. Optic neuritis or focal leg weakness may lead to falls and other serious accidents.

Several therapies have proven helpful for treatment of multiple sclerosis. The aims of treatment include returning function after an attack, preventing new attacks, and preventing disability. During symptomatic attacks administration of high doses of intravenous corticosteroids, such as methylprednisolone, is the routine therapy for acute relapses. Disease-modifying treatments including interferons (e.g., AVONEX®, REBIF®, BETAFERON®), glatiramer acetate (e.g., COPAXONE®), immunosuppressant (e.g., mitoxantrone) and natalizumab (e.g., TYSABRI®) are used for relapsing-remitting MS.

In human active demyelinating lesions, phagocytic macrophages are MMP-12 positive, suggesting a role for MMP-12 during demyelination in MS (Vos et al. J Neuroimmunol 2003: 138(1-2): 106).

The disclosure provides methods of treating or preventing MS (e.g., ameliorating symptoms or the worsening of MS) by administering a therapeutically effective amount of a MMP-12 binding protein (e.g., an inhibitory MMP-12 binding protein, e.g., an anti-MMP-12 IgG or Fab) to a subject having or suspected of having MS. Also provided are methods of treating MS by administering a therapeutically effective amount of a MMP-12 binding protein with another MS treatment (e.g., interferons (e.g., AVONEX®, REBWF®, BETAFERON®), glatiramer acetate (e.g., COPAXONE®), immunosuppressant (e.g., mitoxantrone) and natalizumab (e.g., TYSABRI®)).

Guidance regarding the efficacy and dosage an MMP-12 binding protein which will deliver a therapeutically effective amount of the protein can be obtained from animal models of MS, see e.g., those described in Toft-Hansen et al. J. Immunol. 2004: 173(8): 5209, Tsutsui et al. Neurosci 2004:24: 1521, Anthony et al. J Neuroimmunol 1998: 87(1-2): 62 and references cited therein.

Abdominal Aortic Aneurysm

Abdominal aortic aneurysm (AAA) is a localized dilatation of the abdominal aorta, that exceeds the normal diameter by more than 50%. The normal diameter of the infrarenal aorta is approximately 2 cm. It is caused by a degenerative process of the aortic wall, however the exact etiology remains unknown. It is most commonly located below the kidneys (infrarenally; 90%), other possible locations are above or at the level of the kidneys (suprarenal and pararenal). The aneurysm can extend to include one or both of the iliac arteries. An aortic aneurysm may also occur in the thorax.

An abdominal aortic aneurysm occurs more commonly in older individuals (between 65 and 75), and more often in men and smokers.

A serious complication of an abdominal aortic aneurysm is rupture, which is often a fatal event. An abdominal aortic aneurysm weakens the walls of the blood vessel, leaving it vulnerable to rupturing. The clinical manifestation of ruptured AAA can include low back, flank, abdominal or groin pain, but the bleeding usually leads to a hypovolemic shock with hypotension, tachycardia, cyanosis, and altered mental status.

Some risk factors for AAA include genetic influences, hemodynamic influences, atherosclerosis, infection, trauma, arteritis, cystic medial necrosis and connective tissue disorders (e.g. Marfan syndrome, Ehlers-Danlos syndrome).

MMP-12 zymogen levels and proteolytic activities are increased in AAAs when compared with healthy aorta, suggesting that chronic aortic wall inflammation is mediated by macrophage infiltration, which may account for the destruction of medial elastin (Annabi et al. J Vasc Surg. 2002: 35(3): 539). MMP-12 is prominently expressed by aneurysm-infiltrating macrophages within the degenerating aortic media of AAA, where it is also bound to residual elastic fiber fragments. Because elastin represents a critical component of aortic wall structure and a matrix substrate for metalloelastases, MMP-12 may have a direct role in the pathogenesis of aortic aneurysms (Curci et al. 1998: 102(11): 1900).

The treatment options for asymptomatic AAA are immediate repair, surveillance with a view to eventual repair, and conservative management. There are currently two modes of repair available for an AAA: open aneurysm repair (OR), and endovascular aneurysm repair (EVAR).

The disclosure provides methods of treating or preventing AAA (e.g., ameliorating symptoms or the worsening of AAA) by administering a therapeutically effective amount of a MMP-12 binding protein (e.g., an inhibitory MMP-12 binding protein, e.g., an anti-MMP-12 IgG or Fab) to a subject having or suspected of having AAA. Also provided are methods of treating AAA by administering a therapeutically effective amount of a MMP-12 binding protein with another AAA treatment (e.g., immediate repair, surveillance with a view to eventual repair, or conservative management).

Guidance regarding the efficacy and dosage an MMP-12 binding protein which will deliver a therapeutically effective amount of the protein can be obtained from animal models of AAA, see e.g., those described in Longo et al. Surgery. 2005: 137(4): 457, Shimizu et al. J Clin Invest. 2004: 114(2): 300 and references cited therein.

Sclerosis

Systemic sclerosis (SSc) is the generalized type of scleroderma, which is a chronic disease characterized by excessive deposits of collagen in the skin or other organs. SSc can be fatal as a result of heart, kidney, lung or intestinal damage autoimmune disease.

Scleroderma affects the skin, and in more serious cases it can affect the blood vessels and internal organs. The more evident symptom is usually the hardening of the skin and associated scarring. Blood vessels may also be more visible. Many SSc patients (over 80%) have vascular symptoms and Raynaud's phenomenon. During an attack, there is discoloration of the hands and feet in response to cold. Raynaud's normally affects the fingers and toes. SSc and Raynaud's can cause painful ulcers on the fingers or toes which are known as digital ulcers. Calcinosis is also common in SSc, and is often seen near the elbows, knees or other joints. Diffuse scleroderma can cause musculoskeletal, pulmonary, gastrointestinal, renal and other complications. Patients with larger amounts of cutaneous involvement are more likely to have involvement of the internal tissues and organs.

There appears to be a familial predisposition for autoimmune disease.

Overproduction of MMP-12 by SSc microvascular endothelial cells (MVECs) has been shown to account for the cleavage of urokinase-type plasminogen activator receptor (uPAR) and the impairment of angiogenesis in vitro and may contribute to reduced angiogenesis in SSc patients (D'Alessio et al. Arthritis Rheum. 2004: 50(10): 3275).

Treatment for some of the symptoms of scleroderma includes drugs that soften the skin and reduce inflammation. Topical treatment for the skin changes of scleroderma do not alter the disease course, but may improve pain and ulceration. A range of NSAIDs (nonsteroidal anti-inflammatory drugs) can be used to ease painful symptoms, such as naproxen. Episodes of Raynaud's phenomenon sometimes respond to nifedipine or other calcium channel blockers; severe digital ulceration may respond to prostacyclin analogue iloprost, and the dual endothelin-receptor antagonist bosentan may be beneficial for Raynaud's phenomenon. The skin tightness may be treated systemically with methotrexate and cyclosporin. Scleroderma renal crisis, the occurrence of acute renal failure and malignant hypertension (very high blood pressure with evidence of organ damage) in people with scleroderma, is effectively treated with drugs from the class of the ACE inhibitors. Active alveolitis is often treated with pulses of cyclophosphamide, often together with a small dose of steroids. Pulmonary hypertension may be treated with epoprostenol, bosentan and possibly aerolized iloprost.

The disclosure provides methods of treating or preventing SSc (e.g., ameliorating symptoms or the worsening of SSc) by administering a therapeutically effective amount of a MMP-12 binding protein (e.g., an inhibitory MMP-12 binding protein, e.g., an anti-MMP-12 IgG or Fab) to a subject having or suspected of having SSc. Also provided are methods of treating SSc by administering a therapeutically effective amount of a MMP-12 binding protein with another SSc treatment (e.g., NSAIDs, calcium channel blockers, prostacyclin analogue, the dual endothelin-receptor antagonist, methotrexate, cyclosporin, ACE inhibitors, cyclophosphamide, epoprostenol, and bosentan).

Nephritis

Nephritis is inflammation of the kidney and is often caused by infections, toxins, and auto-immune diseases. Subtypes include glomerulonephritis, interstitial nephritis or tubulo-interstitial nephritis, pyelonephritis and Lupus nephritis.

Nephritis is a common cause of glomerular injury. It is a disturbance of the glomerular structure with inflammatory cell proliferation. This can lead to: reduced glomerular blood flow leading to reduced urine output (oliguria) and retention of waste products (uremia). As a result, there can also be leakage of red blood cells from damaged glomerulus (hematuria). Low renal blood flow activates the renin-angiotensin-aldosterone system (RAAS), which therefore causes fluid retention and mild hypertension.

MMP-12 is one of the highly expressed genes in the kidneys on days 3 and 7 after the injection of anti-GBM (glomerular basement membrane) antiserum in a Rat crescentic glomerulonephritis model (Kaneko et al. J. Immunol. 2003: 170(6): 3373).

As a subset of nephritis, e.g. pyelonephritis, are often due to bacterial infections, antibiotics are the mainstay of treatment.

The disclosure provides methods of treating or preventing nephritis (e.g., ameliorating symptoms or the worsening of nephritis) by administering a therapeutically effective amount of a MMP-12 binding protein (e.g., an inhibitory MMP-12 binding protein, e.g., an anti-MMP-12 IgG or Fab) to a subject having or suspected of having nephritis. Also provided are methods of treating nephritis by administering a therapeutically effective amount of a MMP-12 binding protein with another nephritis treatment (e.g. antibiotics).

Guidance regarding the efficacy and dosage an MMP-12 binding protein which will deliver a therapeutically effective amount of the protein can be obtained from animal models of nephritis, see e.g., those described in Kaneko et al. J. Immunol. 2003: 170(6): 3373, and references cited therein.

Wound Healing

Wound healing, or wound repair, is the process of regenerating dermal and epidermal tissue. When an individual is wounded, a set of complex biochemical events takes place in a closely orchestrated cascade to repair the damage. These events overlap in time and may be artificially categorized into separate steps: the inflammatory, proliferative, and remodeling phases.

By regulating the proliferation of corneal epithelial cells, MMP-12 appears to contribute to corneal wound healing (Lyu et al. J Biol. Chem. 2005: 280(22): 21653). Epithelial expression of MMP-12 in chronic wounds provides a diagnostic clue for distinguishing squamous cell carcinoma (SCCs) from nonmalignant wounds (Impola et al. Br J. Dermatol. 2005: 152(4): 720).

The disclosure provides methods of treating wound (e.g., ameliorating symptoms or the worsening of wound) by administering a therapeutically effective amount of a MMP-12 binding protein (e.g., an inhibitory MMP-12 binding protein, e.g., an anti-MMP-12 IgG or Fab) to a subject having or suspected of having wound. Also provided are methods of treating wound by administering a therapeutically effective amount of a MMP-12 binding protein with another wound treatment.

Encephalomyelitis and Neuroinflammatory Disorders

Encephalomyelitis, e.g., experimental autoimmune encephalomyelitis, sometimes Experimental Allergic Encephalomyelitis (EAE), is an animal model of brain inflammation. It is an inflammatory demyelinating disease of the central nervous system (CNS). It is often used with rodents and is widely studied as an animal model of the human CNS demyelinating diseases, including the diseases multiple sclerosis and acute disseminated encephalomyelitis. EAE can be induced by inoculation with whole CNS tissue, purified myelin basic protein (MBP) or myelin proteolipid protein (PLP), together with adjuvants. It may also be induced by the passive transfer of T cells specifically reactive to these myelin antigens. EAE may have either an acute or a chronic relapsing course. Acute EAE closely resembles the human disease acute disseminated encephalomyelitis, while chronic relapsing EAE resembles multiple sclerosis. EAE is also the prototype for T-cell-mediated autoimmune disease in general.

MMP-12 is overexpressed in spinal cord from SJL/J mice and mice with adoptively transferred myelin basic protein (MBP)-specific EAE (Toft-Hansen et al. J. Immunol. 2004: 173(8): 5209). In human, aberrant expression of MMP-12 has been implicated in the pathogenesis of immune-mediated neuroinflammatory disorders (Hughes et al. Neuroscience. 2002: 113(2):273).

The disclosure provides methods of treating or preventing encephalomyelitis, e.g., EAE, and neuroinflammatory disorders (e.g., ameliorating symptoms or the worsening of encephalomyelitis and neuroinflammatory disorders) by administering a therapeutically effective amount of a MMP-12 binding protein (e.g., an inhibitory MMP-12 binding protein, e.g., an anti-MMP-12 IgG or Fab) to a subject having or suspected of having EAE and neuroinflammatory disorders. Also provided are methods of treating encephalomyelitis and neuroinflammatory disorders by administering a therapeutically effective amount of a MMP-12 binding protein with another nephritis treatment.

Guidance regarding the efficacy and dosage an MMP-12 binding protein which will deliver a therapeutically effective amount of the protein can be obtained from animal models of encephalomyelitis and neuroinflammatory disorders, see e.g., those described in Toft-Hansen et al. J. Immunol. 2004: 173(8): 5209, and references cited therein.

Aging

In biology, senescence is the state or process of aging. Cellular senescence is a phenomenon where isolated cells demonstrate a limited ability to divide in culture, while organismal senescence is the aging of organisms.

Organismal senescence is characterized by the declining ability to respond to stress, increasing homeostatic imbalance and increased risk of disease. As genes that have an effect on aging are discovered, aging is increasingly being regarded in a similar fashion to other genetic conditions.

In humans and other animals, cellular senescence has been attributed to the shortening of telomeres with each cell cycle; when telomeres become too short, the cells die. Other genes are known to affect the aging process, the sirtuin family of genes have been shown to have a significant effect on the lifespan of yeast and nematodes. Over-expression of the RAS2 gene increases lifespan in yeast substantially. In addition to genetic ties to lifespan, diet has been shown to substantially affect lifespan in many animals.

The level of MMP-12 increases in the insoluble fraction of old mice, suggesting increased extracellular matrix (ECM) degradative capacity and MMP-12 may contribute to age-dependent ECM remodeling (Lindsey et al. Cardiovasc Res. 2005: 66(2):410.) Heat treatment increases MMP-12 mRNA and protein expression in human skin suggesting that MMP-12 may contribute to skin aging by accumulation of elastotic material in photoaged skin (Chen et al. J Invest Dermatol. 2005: 124(1):70). MMP-12 may also contribute to skin aging by remodeling of elastotic areas in sun-damaged skin (Saarialho-Kere et al. J Invest Dermatol. 1999: 113(4):664).

The disclosure provides methods of treating or preventing aging (e.g., ameliorating symptoms or the worsening of aging e.g. skin aging) by administering a therapeutically effective amount of a MMP-12 binding protein (e.g., an inhibitory MMP-12 binding protein, e.g., an anti-MMP-12 IgG or Fab) to a subject having or suspected of having aging (e.g. skin aging). Also provided are methods of treating aging by administering a therapeutically effective amount of a MMP-12 binding protein with another aging treatment.

Viral Encephalitis

Viral encephalitis is an acute inflammation of the brain caused by a viral infection. Brain damage occurs as the inflamed brain pushes against the skull, and can lead to death.

Patients with encephalitis suffer from fever, headache and photophobia with weakness and seizures also common. Less commonly, stiffness of the neck can occur with rare cases of patients also suffering from stiffness of the limbs, slowness in movement and clumsiness depending on which specific part of the brain is involved. The symptoms of encephalitis are caused by the brain's defense mechanisms activating to get rid of the infection.

Treatment is usually symptomatic. Reliably tested specific antiviral agents are available only for a few viral agents (e.g. acyclovir for herpes simplex virus). In patients who are very sick, supportive treatment, such as mechanical ventilation, is also important.

Infection of the murine central nervous system (CNS) with a neurotropic coronavirus induces encephalitis associated with increased levels of mRNA encoding MMP-12 (Zhou et al. J. Virol. 2005: 79(8):4764).

The disclosure provides methods of treating or preventing viral encephalitis (e.g., ameliorating symptoms or the worsening of viral encephalitis) by administering a therapeutically effective amount of a MMP-12 binding protein (e.g., an inhibitory MMP-12 binding protein, e.g., an anti-MMP-12 IgG or Fab) to a subject having or suspected of having viral encephalitis. Also provided are methods of treating viral encephalitis by administering a therapeutically effective amount of a MMP-12 binding protein with another viral encephalitis treatment (e.g., acyclovir, mechanical ventilation).

Guidance regarding the efficacy and dosage an MMP-12 binding protein which will deliver a therapeutically effective amount of the protein can be obtained from animal models of viral encephalitis, see e.g., those described in Zhou et al. J. Virol. 2005: 79(8):4764, and references cited therein.

Stroke

Stroke is the rapidly developing loss of brain functions due to a disturbance in the blood vessels supplying blood to the brain. This can be due to ischemia (lack of blood supply) caused by thrombosis or embolism, or due to a hemorrhage. In an ischemic stroke, blood supply to part of the brain is decreased, leading to dysfunction and necrosis of the brain tissue in that area. Intracranial hemorrhage is the accumulation of blood anywhere within the skull vault. A distinction is made between intra-axial hemorrhage (blood inside the brain) and extra-axial hemorrhage (blood inside the skull but outside the brain). Intra-axial hemorrhage is due to intraparenchymal hemorrhage or intraventricular hemorrhage (blood in the ventricular system). The main types of extra-axial hemorrhage are epidural hematoma (bleeding between the dura mater and the skull), subdural hematoma (in the subdural space) and subarachnoid hemorrhage (between the arachnoid mater and pia mater). Most of the hemorrhagic stroke syndromes have specific symptoms (e.g. headache, previous head injury).

Stroke symptoms typically develop rapidly (seconds to minutes). The symptoms of a stroke are related to the anatomical location of the damage; nature and severity of the symptoms can therefore vary widely. Ischemic strokes usually only affect regional areas of the brain perfused by the blocked artery. Hemorrhagic strokes can affect local areas, but often can also cause more global symptoms due to bleeding and increased intracranial pressure.

In mice MMP-12 expression following haemorrhagic stroke is deleterious and contributes to the development of secondary injury in this disease (Wells et al. Eur J. Neurosci. 2005: 21(1):187). Transcript level of MMP-12 in carotid atherosclerotic plaques is correlated with histological features and clinical manifestations, supporting a role of MMP-12 in determining atherosclerotic plaque stability (Morgan et al. Stroke. 2001: 32(9):2198).

Treatment for stroke includes pharmacologic thrombolysis ("clot busting") with the drug tissue plasminogen activator, tPA, to dissolve the clot and unblock the artery. Another treatment for acute ischemic stroke is removal of the offending thrombus directly. This is accomplished by inserting a catheter into the femoral artery, directing it into the cerebral circulation, and deploying a corkscrew-like device to ensnare the clot, which is then withdrawn from the body. Anticoagulation can prevent recurrent stroke. Patients with bleeding into (intracerebral hemorrhage) or around the brain (subarachnoid hemorrhage), require neurosurgical evaluation to detect and treat the cause of the bleeding.

The disclosure provides methods of treating or preventing stroke (e.g., ameliorating symptoms or the worsening of stroke) by administering a therapeutically effective amount of a MMP-12 binding protein (e.g., an inhibitory MMP-12 binding protein, e.g., an anti-MMP-12 IgG or Fab) to a subject having or suspected of having stroke. Also provided are methods of treating stroke by administering a therapeutically effective amount of a MMP-12 binding protein with another stroke treatment (e.g., thrombolysis, plasminogen activator, anticoagulation or surgical procedures).

Guidance regarding the efficacy and dosage an MMP-12 binding protein which will deliver a therapeutically effective amount of the protein can be obtained from animal models of stroke, see e.g., those described in Wells et al. Eur J. Neurosci. 2005: 21(1):187), and references cited therein.

Enterocolitis

Enterocolitis (or "coloenteritis") is an inflammation of both the small and large intestine. Enteritis is the inflammation of the small intestine and colitis is inflammation of the large intestine, especially the colon.

Symptoms for enteritis may include abdominal pain, diarrhea, abdominal distension and hematochezia. General signs and symptoms of colitis include pain, tenderness in the abdomen, depression, rapid weight loss, aches and pains within the joints, fatigue, changes in bowel habits (increased frequency), fever; swelling of the colon tissue, erythema (redness) of the surface of the colon, ulcers on the colon (in ulcerative colitis) which can bleed, mucous in the stool, blood in stool and rectal bleeding. Other symptoms may include: diarrhea, gas, bloating, indigestion, heartburn, reflux, Gastro oesophageal reflux disease (GORD), cramps, urgency and many other uncomfortable aches in the gastrointestinal system.

MMP-12 is up-regulated in necrotizing enterocolitis (NEC), suggesting it might be a major factor in tissue destruction and remodeling in NEC (Bista et al. J Pediatr Gastroenterol Nutr. 2005:40(1):60).

Viral diarrhea is usually self-limiting and is treated with rehydration. When bacterial causes are suspected, antibiotics can be considered. Treatment of colitis includes administration of antibiotics and general non-steroidal anti-inflammatory (NSAIDS) medications such as Mesalamine (Asacol®) or its derivatives; Azathioprine or similar immunosupressants; steroids such as prednisolone and prednisone; drugs that ameliorate inflammation and pain (buscopan).

The disclosure provides methods of treating or preventing enterocolitis (e.g., ameliorating symptoms or the worsening of enterocolitis) by administering a therapeutically effective amount of a MMP-12 binding protein (e.g., an inhibitory MMP-12 binding protein, e.g., an anti-MMP-12 IgG or Fab) to a subject having or suspected of having enterocolitis. Also provided are methods of treating enterocolitis by administering a therapeutically effective amount of a MMP-12 binding protein with another enterocolitis treatment (e.g., rehygration, antibiotics, NSAIDS, Mesalamine (Asacol®) or its derivatives; Azathioprine or similar immunosupressants; steroids such as prednisolone and prednisone; drugs that ameliorate inflammation and pain (buscopan)).

Celiac Disease

Coeliac disease (CD), or celiac disease, is an autoimmune disorder of the small intestine that occurs in genetically predisposed people of all ages from middle infancy.

Symptoms include chronic diarrhoea, failure to thrive (in children), and fatigue, but these may be absent and symptoms in all other organ systems have been described.

CD is caused by a reaction to gliadin, a gluten protein found in wheat (and similar proteins of the tribe Triticeae which includes other cultivars such as barley and rye). Upon exposure to gliadin, the enzyme tissue transglutaminase modifies the protein, and the immune system cross-reacts with the bowel tissue, causing an inflammatory reaction. That leads to flattening of the lining of the small intestine, which interferes with the absorption of nutrients.

The presence of a peculiar MMP pattern in active CD strongly dominated by MMP-12 correlates either with IFN-gamma or the degree of mucosal damage (Ciccocioppo et al. J Pediatr Gastroenterol Nutr. 2005: 85(3):397).

Treatment for CD is a gluten-free diet.

The disclosure provides methods of treating or preventing CD (e.g., ameliorating symptoms or the worsening of CD) by administering a therapeutically effective amount of a MMP-12 binding protein (e.g., an inhibitory MMP-12 binding protein, e.g., an anti-MMP-12 IgG or Fab) to a subject having or suspected of having CD. Also provided are methods of treating CD by administering a therapeutically effective amount of a MMP-12 binding protein with another CD treatment (e.g., gluten-free diet).

Spinal Cord Injury

Spinal cord injury (SCI) causes myelopathy or damage to white matter or myelinated fiber tracts that carry sensation and motor signals to and from the brain. It also damages gray matter in the central part of the spinal cord, causing segmental losses of interneurons and motorneurons. Spinal cord injury can occur from many causes, including: trauma, tumor, ischemia, developmental discorders, neurodegernerative diseases, demyelinative diseases, transverse myelitis, and vascular malformations.

MMP-12 expression after spinal cord trauma is deleterious in mice and contributes to the development of secondary injury in SCI (Wells et al. J. Neurosci. 2003: 23(31): 10107).

Treatment for acute traumatic spinal cord injuries includes giving a high dose methylprednisolone if the injury occurred within 8 hours. The recommendation is primarily based on the National Acute Spinal Cord Injury Studies (NASCIS) II and III.

The disclosure provides methods of treating or preventing SCI (e.g., ameliorating symptoms or the worsening of SCI) by administering a therapeutically effective amount of a MMP-12 binding protein (e.g., an inhibitory MMP-12 binding protein, e.g., an anti-MMP-12 IgG or Fab) to a subject having or suspected of having SCI. Also provided are methods of treating SCI by administering a therapeutically effective amount of a MMP-12 binding protein with another SCI treatment (e.g., methylprednisolone).

Guidance regarding the efficacy and dosage an MMP-12 binding protein which will deliver a therapeutically effective amount of the protein can be obtained from animal models of SCI, see e.g., those described in Wells et al. J. Neurosci. 2003: 23(31): 10107), and references cited therein.

Acute Lung Injury in Hyperoxia

Acute lung injury could be a side effect of therapy with a high concentration of inspired oxygen in patients.

Overexpression of Stat3C, a constitutive active form of STAT3, in respiratory epithelial cells of a doxycycline-controlled double-transgenic mouse system protects lung from inflammation and injury caused by hyperoxia. This protection is mediated at least partially through inhibition of hyperoxia-induced synthesis and release of MMP-12 by neutrophils and alveolar resident cells (Lian et al. J Immunol. 2005: 174(11): 7250).

The disclosure provides methods of treating or preventing acute lung injury in hyperoxia (e.g., ameliorating symptoms or the worsening of acute lung injury in hyperoxia) by administering a therapeutically effective amount of a MMP-12 binding protein (e.g., an inhibitory MMP-12 binding protein, e.g., an anti-MMP-12 IgG or Fab) to a subject having or suspected of having acute lung injury in hyperoxia. Also provided are methods of treating acute lung injury in hyperoxia by administering a therapeutically effective amount of a MMP-12 binding protein with another acute lung injury in hyperoxia treatment.

Guidance regarding the efficacy and dosage an MMP-12 binding protein which will deliver a therapeutically effective amount of the protein can be obtained from animal models of acute lung injury in hyperoxia, see e.g., those described in Lian et al. J Immunol. 2005: 174(11):7250, and references cited therein.

Pulmonary Inflammatory Diseases

Studies using animal models of acute and chronic pulmonary inflammatory diseases have given evidences that MMP-12 is an important mediator of the pathogenesis of these diseases. MMP inhibitor, marimastat could reverse some of these inflammatory events (Menan et al. Mem Inst Oswaldo Cruz. 2005: 100:167). MMP-12 also plays an important proinflammatory role in the development of allergic inflammation in a mouse model of allergic airway inflammation induced by cockroach antigen (CRA) (Warner et al. Am J. Pathol. 2004:165(6):1921).

The disclosure provides methods of treating or preventing pulmonary inflammatory diseases (e.g., ameliorating symptoms or the worsening of pulmonary inflammatory diseases) by administering a therapeutically effective amount of a MMP-12 binding protein (e.g., an inhibitory MMP-12 binding protein, e.g., an anti-MMP-12 IgG or Fab) to a subject having or suspected of having pulmonary inflammatory diseases. Also provided are methods of treating pulmonary inflammatory diseases by administering a therapeutically effective amount of a MMP-12 binding protein with another pulmonary inflammatory diseases treatment (e.g. antibiotics).

Guidance regarding the efficacy and dosage an MMP-12 binding protein which will deliver a therapeutically effective amount of the protein can be obtained from animal models of pulmonary inflammatory diseases, see e.g., those described in Warner et al. Am J. Pathol. 2004:165(6):1921, and references cited therein.

Combination Therapies

The MMP-12 binding proteins described herein, e.g., anti-MMP-12 Fabs or IgGs, can be administered in combination with one or more of the other therapies for treating a disease or condition associated with MMP-12 activity, e.g., a disease or condition described herein. For example, an MMP-12 binding protein can be used therapeutically or prophylactically with surgery, another MMP-12 inhibitor, e.g., a small molecule inhibitor, another anti-MMP-12 Fab or IgG (e.g., another Fab or IgG described herein), peptide inhibitor, or small molecule inhibitor. Examples of MMP-12 inhibitors that can be used in combination therapy with an MMP-12 binding protein are described herein.

One or more small-molecule MMP inhibitors can be used in combination with one or more MMP-12 binding proteins described herein. For example, the combination can result in a lower dose of the small-molecule inhibitor being needed, such that side effects are reduced.

The MMP-12 binding proteins described herein can be administered in combination with one or more of the other therapies for treating cancers, including, but not limited to: surgery; radiation therapy, and chemotherapy. For example, proteins that inhibit MMP-12 or that inhibit a downstream event of MMP-12 activity can also be used in combination with other anti-cancer therapies, such as radiation therapy, chemotherapy, surgery, or administration of a second agent. For example, the second agent can be a Tie-1 inhibitor (e.g., Tie-1 binding proteins; see e.g., U.S. Ser. No. 11/199,739 and PCT/US2005/0284, both filed Aug. 9, 2005). As another example, the second agent can be one that targets or negatively regulates the VEGF signaling pathway. Examples of this latter class include VEGF antagonists (e.g., anti-VEGF antibodies such as bevacizumab) and VEGF receptor antagonists (e.g., anti-VEGF receptor antibodies). One particularly preferred combination includes bevacizumab. As a further example, the second agent is an inhibitor of plasmin, such as a kunitz domain-containing protein or polypeptide (e.g., a plasmin-inhibiting kunitz domain disclosed in U.S. Pat. No. 6,010,880, such as a protein or polypeptide comprising the amino acid sequence

```
MHSFCAFKAETGPCRARFDRWFFNIFTRQC      (SEQ ID NO: 1))
EEFIYGGCEGNQNRFESLEECKKMCTRD
```

As another example, the second agent is an agent that binds to Her2, such as a Her2-binding antibody (e.g., trastuzumab). The combination can further include 5-FU and leucovorin, and/or irinotecan.

Inhibitors of MMP-12 (e.g., the MMP-12 binding proteins disclosed herein) can potentiate the activity of an agent that targets Her2 (e.g., a Her2-binding antibody such as trastuzumab). Accordingly, in one combination therapy for the treatment of breast cancer, the second therapy is an agent that binds Her2, such as a Her2-binding antibody (e.g., trastuzumab). When an MMP-12 binding protein is used in a combination therapy with a Her2 binding agent, the dose of the Her2 binding agent may be reduced from the dose of the Her2 binding agent when administered not in combination with an MMP-12 binding protein (e.g., is at least 10%, 25%, 40%, or 50% less than the dose of the Her2 binding agent when administered not in combination with a MMP-12 binding protein). For example, the dose of trastuzumab, when administered in a combination therapy with an MMP-12 binding protein is less than about 4.0, 3.6, 3.0, 2.4, or 2 mg/kg as an initial (loading) dose, and less than about 2.0, 1.8, 1.5, 1.2, or 1 mg/kg in subsequent doses.

The MMP-12 binding proteins described herein can also be administered in combination with one or more other therapies for treating ocular disorders, such as surgical or medical (e.g., administration of a second agent) therapies. For example, in treatment of age-related macular degeneration (e.g., wet age-related macular degeneration), an MMP-12 binding protein may be administered in conjunction with (e.g., before, during, or after) laser surgery (laser photocoagulation or photocoagulation therapy). As another example, the MMP-12 binding protein can be administered in combination with a second agent, such as a VEGF antagonist (e.g., an anti-VEGF antibody such as bevacizumab or ranibizumab) or a VEGF receptor antagonist (e.g., anti-VEGF receptor antibodies).

Other combinations are described above.

The term "combination" refers to the use of the two or more agents or therapies to treat the same patient, wherein the use or action of the agents or therapies overlap in time. The agents or therapies can be administered at the same time (e.g., as a single formulation that is administered to a patient or as two separate formulations administered concurrently) or sequentially in any order. Sequential administrations are administrations that are given at different times. The time between administration of the one agent and another agent can be minutes, hours, days, or weeks. The use of an MMP-12 binding protein described herein can also be used to reduce the dosage of another therapy, e.g., to reduce the side-effects associated with another agent that is being administered, e.g., to reduce the side-effects of an anti-VEGF antibody such as bevacizumab. Accordingly, a combination can include administering a second agent at a dosage at least 10, 20, 30, or 50% lower than would be used in the absence of the MMP-12 binding protein.

In addition, a subject can be treated for an angiogenesis-associated disorder, e.g., a cancer, by administering to the subject a first and second agent. For example, the first agent modulates early stage angiogenesis and the second agent modulates a subsequent stage of angiogenesis or also modulates early stage angiogenesis. The first and second agents can be administered using a single pharmaceutical composition or can be administered separately. In one embodiment, the first agent is a VEGF pathway antagonist (e.g., an inhibitor of a VEGF (e.g., VEGF-A, -B, or -C) or a VEGF receptor (e.g., KDR or VEGF receptor III (Flt4)) or a bFGF pathway antagonist (e.g., an antibody that binds to bFGF or a bFGF receptor). Other VEGF pathway antagonists are also described, herein and elsewhere. In one embodiment, the second agent inhibits or decreases the mobility or invasiveness of tumor cells. For example, the second agent comprises an MMP-12 binding protein. For example, the second agent is an MMP-12 binding protein described herein.

Once a tumor reaches a certain size (e.g., ~1-2 mm), the tumor requires new vasculature prior to increasing its mass. An early stage of tumor angiogenesis can include a signal from the tumor, e.g., secretion of VEGF, to stimulate the growth of new blood vessels from the host and infiltration of the tumor by the vessels. VEGF can, for example, stimulate proliferation of endothelial cells that are then assembled into blood vessels. A late stage of tumor growth can include metastasis, mobility and invasiveness of tumor cells. This mobility and invasiveness may involve the action of matrix metalloproteinases, e.g., MMP-12. Thus, an effective therapy to treat angiogenesis-related disorders can involve a combination of an agent that modulates an early stage angiogenesis (e.g., VEGF pathway antagonists, e.g., anti-VEGF (e.g., bevacizumab) or anti-VEGF receptor (e.g., anti-KDR) antibodies; or antagonists of other pro-angiogenic pathways, e.g., anti-bFGF antibodies or anti-bFGF receptor (e.g., anti-bFGF receptor-1, -2, -3) antibodies) and an agent that modulates a late stage of tumor growth can include metastasis, mobility and invasiveness of tumor cells s (e.g., antagonists of MMP-12 (e.g., anti-MMP-12 antibodies (e.g., an antibody disclosed herein)). One or more of these agents can be used in combination. One or more of these agents may also be used in combination with other anti-cancer therapies, such as radiation therapy or chemotherapy.

Exemplary VEGF receptor antagonists include inhibitors of a VEGF (e.g., VEGF-A, -B, or -C, for example bevacizumab), modulators of VEGF expression (e.g., INGN-241, oral tetrathiomolybdate, 2-methoxyestradiol, 2-methoxyestradiol nanocrystal dispersion, bevasiranib sodium, PTC-299, Veglin), inhibitors of a VEGF receptor (e.g., KDR or VEGF receptor III (Flt4), for example anti-KDR antibodies, VEGFR2 antibodies such as CDP-791, IMC-1121B, VEGFR2 blockers such as CT-322), VEGFR3 antibodies such as mF4-31C1 from Imclone Systems, modulators of VEGFR expression (e.g., VEGFR1 expression modulator Sirna-027) or inhibitors of VEGF receptor downstream signaling.

Exemplary inhibitors of VEGF include bevacizumab, pegaptanib, ranibizumab, NEOVASTAT®, AE-941, VEGF Trap, and PI-88.

Exemplary VEGF receptor antagonists include inhibitors of VEGF receptor tyrosine kinase activity. 4-[4-(1-Amino-1-methylethyl)phenyl]-2-[4-(2-morpholin-4-yl-ethyl)phenylamino]pyrimidine-5-carbonitrile (JNJ-17029259) is one of a structural class of 5-cyanopyrimidines that are orally available, selective, nanomolar inhibitors of the vascular endothelial growth factor receptor-2 (VEGF-R2). Additional examples include: PTK-787/ZK222584(Astra-Zeneca), SU5416, SU11248 (Pfizer), and ZD6474 ([N-(4-bromo-2-fluorophenyl)-6-methoxy-7-[(1-methylpiperidin-4-yl)methoxy]quinazolin-4-amine]), vandetanib, cediranib, AG-013958, CP-547632, E-7080, XL-184, L-21649, and ZK-304709. Other VEGF antagonist agents are broad specificity tyrosine kinase inhibitors, e.g., SU6668 (see, e.g., Bergers, B. et al., 2003 J. Clin. Invest. 111:1287-95), sorafenib, sunitinib, pazopanib, vatalanib, AEE-788, AMG-706, axitinib, BIBF-1120, SU-14813, XL-647, XL-999, ABT-869, BAY-57-9352, BAY-73-4506, BMS-582664, CEP-7055, CHIR-265, OSI-930, and TKI-258. Also useful are agents that down regulate VEGF receptors on the cell surface, such as fenretinide, and agents which inhibit VEGF receptor downstream signaling, such as squalamine The second agent or therapy can also be another anti-cancer agent or therapy. Non-limiting examples of anti-cancer agents include, e.g., anti-microtubule agents, topoisomerase inhibitors, antimetabolites, mitotic inhibitors, alkylating agents, intercalating agents, agents capable of interfering with a signal transduction pathway, agents that promote apoptosis, radiation, and antibodies against other tumor-associated antigens (including naked antibodies, immunotoxins and radioconjugates). Examples of the particular classes of anti-cancer agents are provided in detail as follows: antitubulin/antimicrotubule, e.g., paclitaxel, vincristine, vinblastine, vindesine, vinorelbin, taxotere; topoisomerase I inhibitors, e.g., irinotecan, topotecan, camptothecin, doxorubicin, etoposide, mitoxantrone, daunorubicin, idarubicin, teniposide, amsacrine, epirubicin, merbarone, piroxantrone hydrochloride; antimetabolites, e.g., 5 fluorouracil (5 FU), methotrexate, 6 mercaptopurine, 6 thioguanine, fludarabine phosphate, cytarabine/Ara C, trimetrexate, gemcitabine, acivicin, alanosine, pyrazofurin, N-Phosphoracetyl-L-Asparate=PALA, pentostatin, 5 azacitidine, 5 Aza 2' deoxycytidine, ara A, cladribine, 5 fluorouridine, FUDR, tiazofurin, N-[5-[N-(3,4-dihydro-2-methyl-4-oxoquinazolin-6-ylmethyl)-N-methylamino]-2-thenoyl]-L-glutamic acid; alkylating agents, e.g., cisplatin, carboplatin, mitomycin C, BCNU=Carmustine, melphalan, thiotepa, busulfan, chlorambucil, plicamycin, dacarbazine, ifosfamide phosphate, cyclophosphamide, nitrogen mustard, uracil mustard, pipobroman, 4 ipomeanol; agents acting via other mechanisms of action, e.g., dihydrolenperone, spiromustine, and desipeptide; biological response modifiers, e.g., to enhance anti-tumor responses, such as interferon; apoptotic agents, such as actinomycin D; and anti-hormones, for example anti-estrogens such as tamoxifen or, for example antiandrogens such as 4'-cyano-3-(4-fluorophenylsulphonyl)-2-hydroxy-2-methyl-3'-(trifluoromethyl) propionanilide.

A combination therapy can include administering an agent that reduces the side effects of other therapies. The agent can be an agent that reduces the side effects of anti-cancer treatments. For example, the agent can be leucovorin.

Combination therapies that include administering an MMP-12 binding protein or other binding protein described herein can also be used to treat a subject having or at risk for another angiogenesis related disorder (e.g., a disorder other than cancer, e.g., disorders that include undesired endothelial cell proliferation or undesirable inflammation, e.g., rheumatoid arthritis).

Diagnostic Uses

Proteins that bind to MMP-12 and identified by the method described herein and/or detailed herein have in vitro and in vivo diagnostic utilities. The MMP-12 binding proteins described herein (e.g., the proteins that bind and inhibit, or the proteins that bind but do not inhibit MMP-12) can be used, e.g., for in vivo imaging, e.g., during a course of treatment for a disease or condition in which MMP-12 is active, e.g., a disease or condition described herein, or in diagnosing a disease or condition described herein.

In one aspect, the disclosure provides a diagnostic method for detecting the presence of an MMP-12, in vitro or in vivo (e.g., in vivo imaging in a subject). The method can include localizing MMP-12 within a subject or within a sample from a subject. With respect to sample evaluation, the method can include, for example: (i) contacting a sample with MMP-12 binding protein; and (ii) detecting location of the MMP-12 binding protein in the sample.

An MMP-12 binding protein can also be used to determine the qualitative or quantitative level of expression of MMP-12 in a sample. The method can also include contacting a reference sample (e.g., a control sample) with the binding protein, and determining a corresponding assessment of the reference sample. A change, e.g., a statistically significant change, in the formation of the complex in the sample or subject relative to the control sample or subject can be indicative of the presence of MMP-12 in the sample. In one embodiment, the MMP-12 binding protein does not cross react with another metalloproteinase.

The MMP-12 binding proteins are also useful for in vivo tumor imaging. Better clinical endpoints are needed to monitor the efficacy of drugs, such as MMP-inhibitors, that are designed to block enzymatic function (Zucker et al, 2001, Nature Medicine 7:655-656). Imaging of tumors in vivo by using labeled MMP-12 binding proteins could be of help to target the delivery of the binding protein to tumors for cancer diagnosis, intraoperative tumor detection, and for investigations of drug delivery and tumor physiology. MMP-12 binding proteins can be used to monitor native enzymatic activity in vivo at invasive sites. Another exemplary method includes: (i) administering the MMP-12 binding protein to a subject; and (iii) detecting location of the MMP-12 binding protein in the subject. The detecting can include determining location or time of formation of the complex.

The MMP-12 binding protein can be directly or indirectly labeled with a detectable substance to facilitate detection of the bound or unbound antibody. Suitable detectable substances include various enzymes, prosthetic groups, fluorescent materials, luminescent materials and radioactive materials.

Complex formation between the MMP-12 binding protein and MMP-12 can be detected by evaluating the binding protein bound to the MMP-12 or unbound binding protein. Conventional detection assays can be used, e.g., an enzyme-linked immunosorbent assays (ELISA), a radioimmunoassay (RIA) or tissue immunohistochemistry. Further to labeling the MMP-12 binding protein, the presence of MMP-12 can be assayed in a sample by a competition immunoassay utilizing standards labeled with a detectable substance and an unlabeled MMP-12 binding protein. In one example of this assay, the biological sample, the labeled standards, and the MMP-12 binding protein are combined and the amount of labeled standard bound to the unlabeled binding protein is determined. The amount of MMP-12 in the sample is inversely proportional to the amount of labeled standard bound to the MMP-12 binding protein.

Fluorophore and chromophore labeled proteins can be prepared. Because antibodies and other proteins absorb light having wavelengths up to about 310 nm, the fluorescent moieties should be selected to have substantial absorption at wavelengths above 310 nm and preferably above 400 nm. A variety of suitable fluorescers and chromophores are described by Stryer, 1968, *Science* 162:526 and Brand, L. et al., 1972, *Annu. Rev. Biochem.* 41:843 868. The proteins can be labeled with fluorescent chromophore groups by conventional procedures such as those disclosed in U.S. Pat. Nos. 3,940,475, 4,289,747, and 4,376,110. One group of fluorescers having a number of the desirable properties described above is the xanthene dyes, which include the fluoresceins and rhodamines. Another group of fluorescent compounds are the naphthylamines. Once labeled with a fluorophore or chromophore, the protein can be used to detect the presence or localization of the MMP-12 in a sample, e.g., using fluorescent microscopy (such as confocal or deconvolution microscopy).

Histological Analysis. Immunohistochemistry can be performed using the proteins described herein. For example, in the case of an antibody, the antibody can be synthesized with a label (such as a purification or epitope tag), or can be detectably labeled, e.g., by conjugating a label or label-binding group. For example, a chelator can be attached to the antibody. The antibody is then contacted to a histological preparation, e.g., a fixed section of tissue that is on a microscope slide. After an incubation for binding, the preparation is washed to remove unbound antibody. The preparation is then analyzed, e.g., using microscopy, to identify if the antibody bound to the preparation.

Of course, the antibody (or other polypeptide or peptide) can be unlabeled at the time of binding. After binding and washing, the antibody is labeled in order to render it detectable.

Protein Arrays. The MMP-12 binding protein can also be immobilized on a protein array. The protein array can be used as a diagnostic tool, e.g., to screen medical samples (such as isolated cells, blood, sera, biopsies, and the like). Of course, the protein array can also include other binding proteins, e.g., that bind to MMP-12 or to other target molecules.

Methods of producing polypeptide arrays are described, e.g., in De Wildt et al., 2000, *Nat. Biotechnol.* 18:989-994; Lueking et al., 1999, *Anal. Biochem.* 270:103-111; Ge, 2000, *Nucleic Acids Res.* 28, e3, I-VII; MacBeath and Schreiber, 2000, *Science* 289:1760-1763; WO 01/40803 and WO 99/51773A1. Polypeptides for the array can be spotted at high speed, e.g., using commercially available robotic apparati, e.g., from Genetic MicroSystems or BioRobotics. The array substrate can be, for example, nitrocellulose, plastic, glass, e.g., surface-modified glass. The array can also include a porous matrix, e.g., acrylamide, agarose, or another polymer.

For example, the array can be an array of antibodies, e.g., as described in De Wildt, supra. Cells that produce the proteins can be grown on a filter in an arrayed format. Polypeptide production is induced, and the expressed polypeptides are immobilized to the filter at the location of the cell. A protein array can be contacted with a labeled target to determine the extent of binding of the target to each immobilized polypeptide. Information about the extent of binding at each address of the array can be stored as a profile, e.g., in a computer database. The protein array can be produced in replicates and used to compare binding profiles, e.g., of a target and a non-target.

FACS (Fluorescence Activated Cell Sorting). The MMP-12 binding protein can be used to label cells, e.g., cells in a sample (e.g., a patient sample). The binding protein is also attached (or attachable) to a fluorescent compound. The cells can then be sorted using fluorescence activated cell sorter (e.g., using a sorter available from Becton Dickinson Immunocytometry Systems, San Jose Calif.; see also U.S. Pat. Nos. 5,627,037; 5,030,002; and 5,137,809). As cells pass through the sorter, a laser beam excites the fluorescent compound while a detector counts cells that pass through and determines whether a fluorescent compound is attached to the cell by detecting fluorescence. The amount of label bound to each cell can be quantified and analyzed to characterize the sample.

The sorter can also deflect the cell and separate cells bound by the binding protein from those cells not bound by the binding protein. The separated cells can be cultured and/or characterized.

In Vivo Imaging. Also featured is a method for detecting the presence of a MMP-12 expressing tissues in vivo. The method includes (i) administering to a subject (e.g., a patient having, e.g., a cancer (e.g., metastatic cancer, e.g., metastatic breast cancer), an inflammatory disease (.g., chronic obstructive pulmonary disease (COPD), asthma, rhinitis (e.g., allergic rhinitis), inflammatory bowel disease, synovitis, rheumatoid arthritis), heart failure, septic shock, neuropathic pain, osteoarthritis, or an ocular condition (e.g., macular degeneration)) an anti-MMP-12 antibody, conjugated to a detectable marker; (ii) exposing the subject to a means for detecting said detectable marker to the MMP-12 expressing tissues or cells. For example, the subject is imaged, e.g., by NMR or other tomographic means.

Examples of labels useful for diagnostic imaging include radiolabels such as $^{131}$I, $^{111}$In, $^{231}$I, $^{99m}$Tc, $^{32}$P, $^{125}$I, $^{3}$H, $^{14}$C, and $^{188}$Rh, fluorescent labels such as fluorescein and rhodamine, nuclear magnetic resonance active labels, positron emitting isotopes detectable by a positron emission tomography ("PET") scanner, chemiluminescers such as luciferin, and enzymatic markers such as peroxidase or phosphatase. Short range radiation emitters, such as isotopes detectable by short range detector probes can also be employed. The protein can be labeled with such reagents; for example, see Wensel and Meares, 1983, *Radioimmunoimaging and Radioimmunotherapy*, Elsevier, N.Y. for techniques relating to the radiolabeling of antibodies and D. Colcher et al., 1986, *Meth. Enzymol.* 121: 802 816.

The binding protein can be labeled with a radioactive isotope (such as $^{14}$C, $^{3}$H, $^{35}$S, $^{125}$I, $^{32}$P, $^{131}$I). A radiolabeled binding protein can be used for diagnostic tests, e.g., an in vitro assay. The specific activity of a isotopically-labeled binding protein depends upon the half life, the isotopic purity of the radioactive label, and how the label is incorporated into the antibody.

In the case of a radiolabeled binding protein, the binding protein is administered to the patient, is localized to cells bearing the antigen with which the binding protein reacts, and is detected or "imaged" in vivo using known techniques such as radionuclear scanning using e.g., a gamma camera or emission tomography. See e.g., A. R. Bradwell et al., "Developments in Antibody Imaging", *Monoclonal Antibodies for Cancer Detection and Therapy*, R. W. Baldwin et al., (eds.), pp 65 85 (Academic Press 1985). Alternatively, a positron emission transaxial tomography scanner, such as designated Pet VI located at Brookhaven National Laboratory, can be used where the radiolabel emits positrons (e.g., $^{11}$C, $^{18}$F, $^{15}$O, and $^{13}$N).

MRI Contrast Agents. Magnetic Resonance Imaging (MRI) uses NMR to visualize internal features of living subject, and is useful for prognosis, diagnosis, treatment, and surgery. MRI can be used without radioactive tracer compounds for obvious benefit. Some MRI techniques are summarized in EP-A-0 502 814. Generally, the differences related to relaxation time constants T1 and T2 of water protons in different environments is used to generate an image. However, these differences can be insufficient to provide sharp high resolution images.

The differences in these relaxation time constants can be enhanced by contrast agents. Examples of such contrast agents include a number of magnetic agents paramagnetic agents (which primarily alter T1) and ferromagnetic or superparamagnetic (which primarily alter T2 response). Chelates (e.g., EDTA, DTPA and NTA chelates) can be used to attach (and reduce toxicity) of some paramagnetic substances (e.g., $Fe^{+3}$, $Mn^{+2}$, $Gd^{+3}$). Other agents can be in the form of particles, e.g., less than 10 mm to about 10 nM in diameter). Particles can have ferromagnetic, antiferromagnetic, or superparamagnetic properties. Particles can include, e.g., magnetite ($Fe_3O_4$), $\gamma$-$Fe_2O_3$, ferrites, and other magnetic mineral compounds of transition elements. Magnetic particles may include: one or more magnetic crystals with and without nonmagnetic material. The nonmagnetic material can include synthetic or natural polymers (such as sepharose, dextran, dextrin, starch and the like).

The MMP-12 binding protein can also be labeled with an indicating group containing of the NMR active $^{19}$F atom, or a plurality of such atoms inasmuch as (i) substantially all of naturally abundant fluorine atoms are the $^{19}$F isotope and, thus, substantially all fluorine containing compounds are NMR active; (ii) many chemically active polyfluorinated compounds such as trifluoracetic anhydride are commercially available at relatively low cost; and (iii) many fluorinated compounds have been found medically acceptable for use in humans such as the perfluorinated polyethers utilized to carry oxygen as hemoglobin replacements. After permitting such time for incubation, a whole body MRI is carried out using an apparatus such as one of those described by Pykett, 1982, *Sci. Am.* 246:78 88 to locate and image tissues expressing MMP-12.

The contents of all references, pending patent applications and published patents, cited throughout this application are hereby expressly incorporated by reference. The following examples provide further illustrate and are not limiting.

EXAMPLES

Example 1

Selection and Screening of Anti-MMP-12 Fabs and IgGs

Selection strategies employed to identify anti-MMP-12 antibodies are:

(1) Selection with capture of a biotinylated form of MMP-12 catalytic domain on a streptavidin coated surface;

(2) Selection with capture of a biotinylated form of proMMP-12 (APMA-activated) on a streptavidin coated surface;

(3) Phage, suitably depleted (e.g., previous contact with streptavidin) were allowed to interact with the target, unbound phage washed away and the output sampled and/or amplified for the next round of selection. This was repeated until the output phage in ELISA analysis indicate a high percentage of binders. The phage clones were converted into sFabs. 88/518 unique sFab were identified by ELISA and sequencing (campaign A) and 168 by sequencing (campaign B). Their ability to inhibit human MMP-12, murine MMP-12 and other MMPs (1, 2, 3, 7, 8, 9, 10, 13, 14, 16, 17 and 24) was determined by usual means. The sFabs were converted to IgG1s.

TABLE I

| | Unique Positive hits | Inhibitors | IC50 (nM) | Specificity/ Crossreactivity |
|---|---|---|---|---|
| MMP12 Campaign A | 88 | 12 (14%) | 6 < sFab < 90 | 100% |
| MMP12 Campaign B | 168 | 7 (4%) | 10 < sFab < 150 | 100% m/hu |

Campaign A:

TABLE II

| | hMMP-12 inhibition Screen: IC$_{50}$ Values: | |
|---|---|---|
| Antibody name | IC$_{50}$ (nM) Large scale purified Fabs | IC50 (nM) IgGs |
| 539A-M0013-D11 | 20.3 | 13.3 |
| 539A-M0013-G12 | 6.7 | 4.1 |
| 539A-M0013-H06 | 11.9 | 5.3 |
| 539A-M0014-C09 | 36.9 | 43.3 |
| 539A-M0014-G11 | 35.0 | 12.3 |
| 539A-M0016-A11 | 8.8 | 2.1 |
| 539A-M0016-H05 | 56.6 | 32.9 |
| 539A-M0019-C05 | 93.0 | 24.5 |
| 539A-M0020-B01 | 74.8 | 34.6 |
| 539A-M0022-C07 | 24.2 | 13.2 |
| 539A-M0027-E11 | 23.9 | 23.7 |

There was no crossreactivity to mouse MMP12.

TABLE III

| Ki values of four of the Campaign A MMP-12 binding proteins that act as inhibitors: | | |
|---|---|---|
| | IC50 values | Ki (nM) |
| 539A-M0016-A11 | 2.1 | 0.7 +/− 0.1 |
| 539A-M0013-D11 | 13.3 | 4.97 +/− 1.4 |
| 539A-M0013-G12 | 4.1 | 2.05 +/− 1.4 |
| 539A-M0013-H06 | 5.3 | 2.7 +/− 1.6 |

The Campaign A MMP-12 binding proteins were crossreacted against other human proteases. The results are provided in Table IV.

TABLE IV

| Anti MMP-12 IgG | MMP-9 | MMP-14 | hTACE |
|---|---|---|---|
| 539A-M0013-D11 | no | no | No |
| 539A-M0013-G12 | no | no | No |
| 539A-M0013-H06 | no | no | No |
| 539A-M0014-C09 | no | no | No |
| 539A-M0014-G11 | no | no | no |
| 539A-M0016-A11 | no | no | no |
| 539A-M0016-H05 | no | no | no |
| 539A-M0019-C05 | no | no | no |
| 539A-M0020-B01 | no | no | no |
| 539A-M0022-C07 | no | no | no |
| 539A-M0025-D04 | no | no | no |
| 539A-M0027-E11 | no | no | no |

Cross-reactivity of some of the campaign A MMP-12 binding proteins was assessed against other human proteases. The results are provided below.

TABLE V

| | 539A-M0016-A11 | 539A-M0013-D11 | 539A-M0013-G12 | 539A-M0013-H06 |
|---|---|---|---|---|
| MMP-1 | no | no | no | no |
| MMP-2 | no | no | no | no |
| MMP-3 | no | no | no | no |
| MMP-7 | no | no | no | no |
| MMP-8 | no | no | no | no |
| MMP-10 | no | no | no | no |
| MMP-13 | no | no | no | no |
| MMP-16 | no | no | no | no |
| MMP-17 | no | no | no | no |
| MMP-24 | no | no | no | no |

Campaign B:

Three selection strategies were used. When the phage outputs in ELISA analysis indicate a high percentage of binders, the phage outputs were converted to sFabs. A high throughput sequencing campaign was done instead of high throughput ELISA and unique sFabs were recovered:

1. Three rounds on mouse MMP12: HT sequencing: 153 unique clones
2. Alternation (human-mouse MMP12): HT sequencing: 120 unique clones
3. Alternation (5 human peptides-mouse MMP12): not pursued 13 inhibitors of mouse MMP-12 were identified including 1 that is cross reactive with human MMP-12.

The following peptides (SEQ ID NOS 7-11) were designed:

TABLE VI

| Peptide | Size | location |
|---|---|---|
| GDAHFDEDEFWT | 12AA | 13AA upstream the Zn binding site |
| GTNLFLTAVHEIGHSLGL | 18AA | Overlap with Zn binding site |
| HEIGHSLGLGHS | 12AA | Zn binding motif |
| TYRINNYTPDMNREDVDY | 18AA | N'term part of the catalytic domain |
| TFRLSADDIRGIQSLYG | 17AA | 17AA downstream the Zn binding motif |

BIOTIN-CG XXXXXXXXXXXXXXXXXX-COOH

Several MMP-12 non-inhibitor antibodies were identified for Campaign B. These antibodies are described in FIG. 1.

In addition, several MMP-12 antibody inhibitors of huMMP12 were identified (100 nM):

TABLE VII

| REARRAY PLATE NAME & WELL # | MASTER PLATE NAME & WELL # | % of activity left with 100 nM in assay 04 Oct. 2006 | % of activity left with 100 nM in assay 29 Aug. 2006 |
|---|---|---|---|
| 539B-R0060-A06 | 539B-M0031-A06 | 126.3 | ND |
| 539B-R0060-C04 | 539B-M0034-C04 | 38.6 | 39.1 |
| 539B-R0060-G03 | 539B-M0039-F01 | 69.4 | 57.8 |
| 539B-R0061-A09 | 539B-M0041-B05 | 35.1 | ND |
| 539B-R0061-B04 | 539B-M0041-G01 | 108.6 | 84.8 |
| 539B-R0061-B07 | 539B-M0042-B06 | 53.6 | ND |
| 539B-R0062-A02 | 539B-M0006-B10 | 68.9 | 65.5 |
| 539B-R0062-B08 | 539B-M0007-H06 | 55.5 | 55.0 |
| 539B-R0062-C10 | 539B-M0008-H09 | 4.6 | 30.0 |
| 539B-R0062-D07 | 539B-M0009-H08 | 102.7 | ND |
| 539B-R0062-E11 | 539B-M0011-H11 | 12.2 | ND |
| 539B-R0062-F10 | 539B-M0015-F02 | 84.1 | ND |
| 539B-R0062-F11 | 539B-M0016-D01 | 48.1 | ND |

Figure 3A:
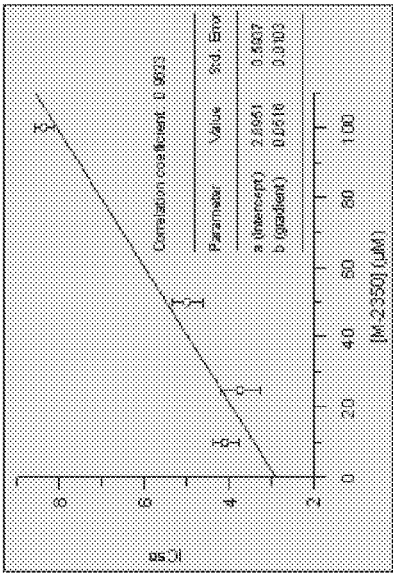
FIGS. 3A and 3B.
Figure 3B:
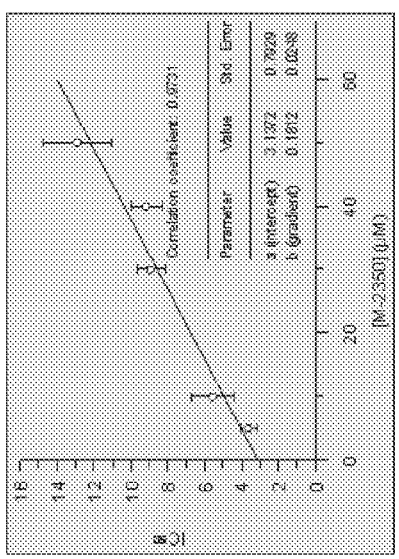

As shown in FIGS. 2A, 2B, and 2C, 539B-M0008-H09 is cross reactive with human MMP-12 and murine MMP-12. 539B-M0008-H09 showed a linear relationship between $IC_{50}$ and concentration (μM) for both human MMP-12 and murione MMP-12, see FIG. 3. The Ki of 539B-M0008-H09 for human MMP-12 is 2.8±0.8 nM and the Km is 16±6 μM. The Ki of 539B-M0008-H09 for murine MMP-12 is 2.2±0.6 nM and the Km is 42±17 μm.

Figure 4B:
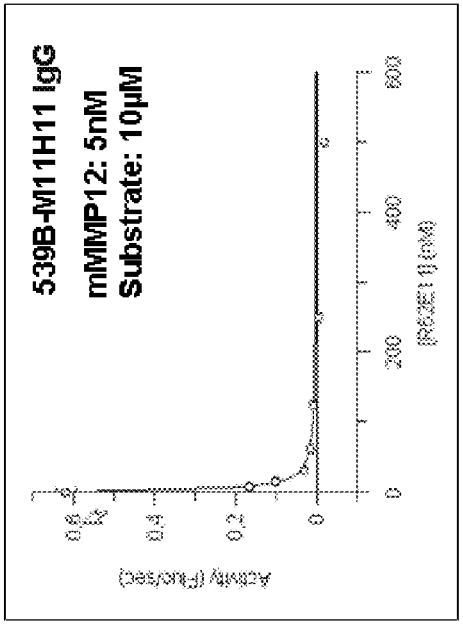
FIGS. 4A and 4B are line graphs showing murine MMP-12 activity (Fluo/sec) in the presence of increasing concentrations (nM) of an MMP-12 binding protein (539B-M11H11 Fab (FIG. 4A) and IgG (FIG. 4B)). The substrate sequence in FIG. 4B is disclosed as SEQ ID NO: 3,401.
Figure 4A:
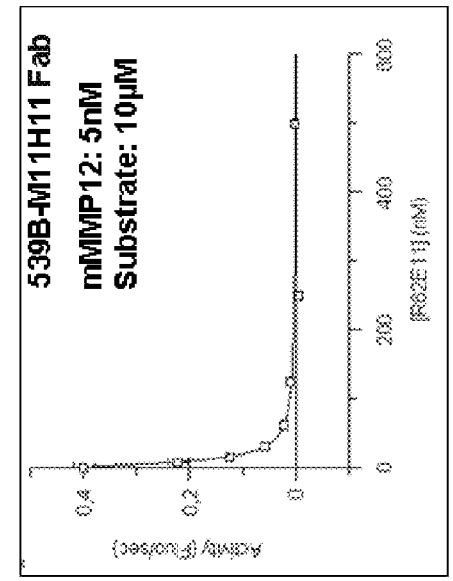

In addition, 539B-M0011-H11 was found to be an inhibitor of murine MMP-12 but not human MMP-12. This is shown in FIG. 4.

The cross reactivity of several MMP-12 binding proteins from Campaign B was assessed for cross reactivity with other MMPs.

TABLE VIII

| | M0016-A11 IgG a-huMMP12 | M0013-G12 IgG a-huMMP12 | M08H09 IgG, 400 nM crossreactive |
|---|---|---|---|
| MMP-1 | N | N | N |
| MMP-2 | N | N | N |
| MMP-3 | N | N | N |
| MMP-7 | N | N | N |
| MMP-8 | N | N | N |
| MMP-9 (m/hu) | N | N | N |
| MMP-10 | N | N | N |
| MMP-12 | Y* | Y* | Y* |
| MMP-13 | N | N | N |
| MMP-14 | N | N | N |
| MMP-15 | N | N | N |
| MMP-16 | N | N | N |
| MMP-17 | N | N | N |
| MMP-24 | N | N | N |

Figure 5:
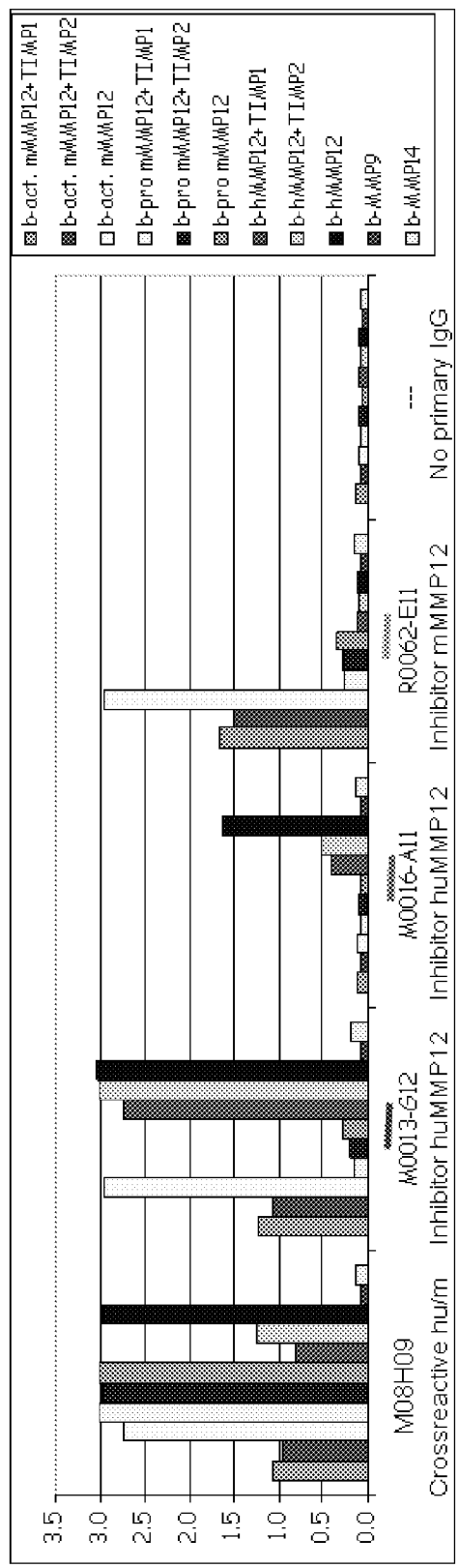
FIG. 5 is a bar graph showing ELISA competition assays with four different MMP-12 binding proteins, M08H09, M0013-G12, M0016-A11 and R0062-E11.

As shown in FIG. 5, using ELIA competition binding assays, it was shown that M08H09 cross reacts with human and murine MMP-12, M0013-G12 and M0016-A11 inhibit human MMP-12 and R0062-E11 inhibits murine MMP-12.

Example 2

Evaluation of M08-H09 on Inflammation

The purpose of the following experiments was to determine the effect of 539B-M008-H09 (M08-H09) on inflammation and specifically on inflammatory cell infiltration into the carrageenan-stimulated mouse air pouch and on the OVA-challenged mouse model.

For the OVA-challenged mouse model, the mice were sensitized by IP administration of OVA/Alum on day 0 and day 7. Six hours prior to OVA challenge, M08-H09 was administered IP to the mice. The mice were challenged by pulmonary administration of OVA. On day 26, metacholine induction and airway hyperresponsiveness was measured. Six different groups were tested. Group 1 was a control group that received PBS. Grous 2, 3, 4 and 5 were administered M08-H09 at doses of 1 mg/kg, 5 mg/kg, 10 mg/kg and 25 mg/kg. Group 6 was administered 25 mg/kg of M1-H11.

The OVA challenged mice were assessed for BAL inflammation based upon differential cell counts, lung histology by quantifying global inflammation, measurement of airway responsiveness to metacholine challenge, IL-4, IL-5 and IL-13 ELISA measurement of BAL or protein lung extracts, serum specific IgE measurement, lung histology using congo red staining to determine eosinophil counts around bronchi and measurement of MMP-12 activity in the lungs using a fluorogenic substrate.

Figure 6:
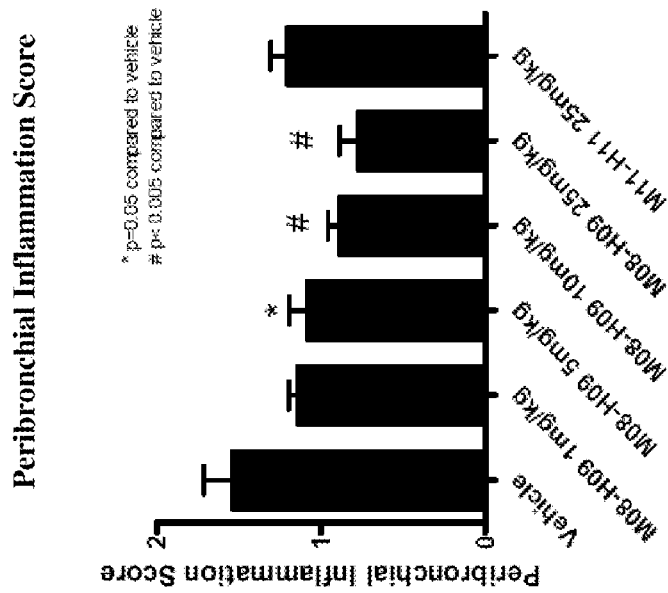
FIG. 6 is a bar graph showing the effect of various doses of MMP-12 binding proteins M08-H09 and M11-H11 on peribronchial inflammation score in OVA-challenged mouse model of airway inflammation.

As shown in FIG. 6, M08-H09 at all doses resulted in a decrease in the peribronchial inflammation score. A significant decrease was seen at 10 mg/kg and 25 mg/kg doses of M08-H09.

Figures 7A, 7B:
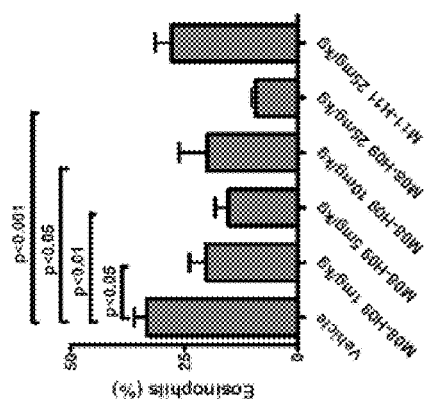
FIGS. 7A and 7B are bar graphs showing eosinophil percentages (FIG. 7A) and counts (FIG. 7B) in OVA-challenged mouse model of airway inflammation administered various doses of MMP-12 binding proteins M08-H09 and M11-H11.

As shown in FIG. 7, the differential cell counts showed that M08-H09 results in eosinophil percentages that are decreased.

For the carrageenan-stimulated mouse air pouch model, subcutaneous injection of air into the hind flank or back of mice produces an air pouch in a week, the interior surface of which contains both fibroblast-like and macrophage-like cells. Inflammatory stimulation of the pouch results in leukocyte recruitment to the pouch and release of mediators (cytokines) into the exudate. Preventing inflammatory cell infiltration into the air pouch may translate into preventing inflammation of the synovium in rheumatoid arthritis.

Figure 8:
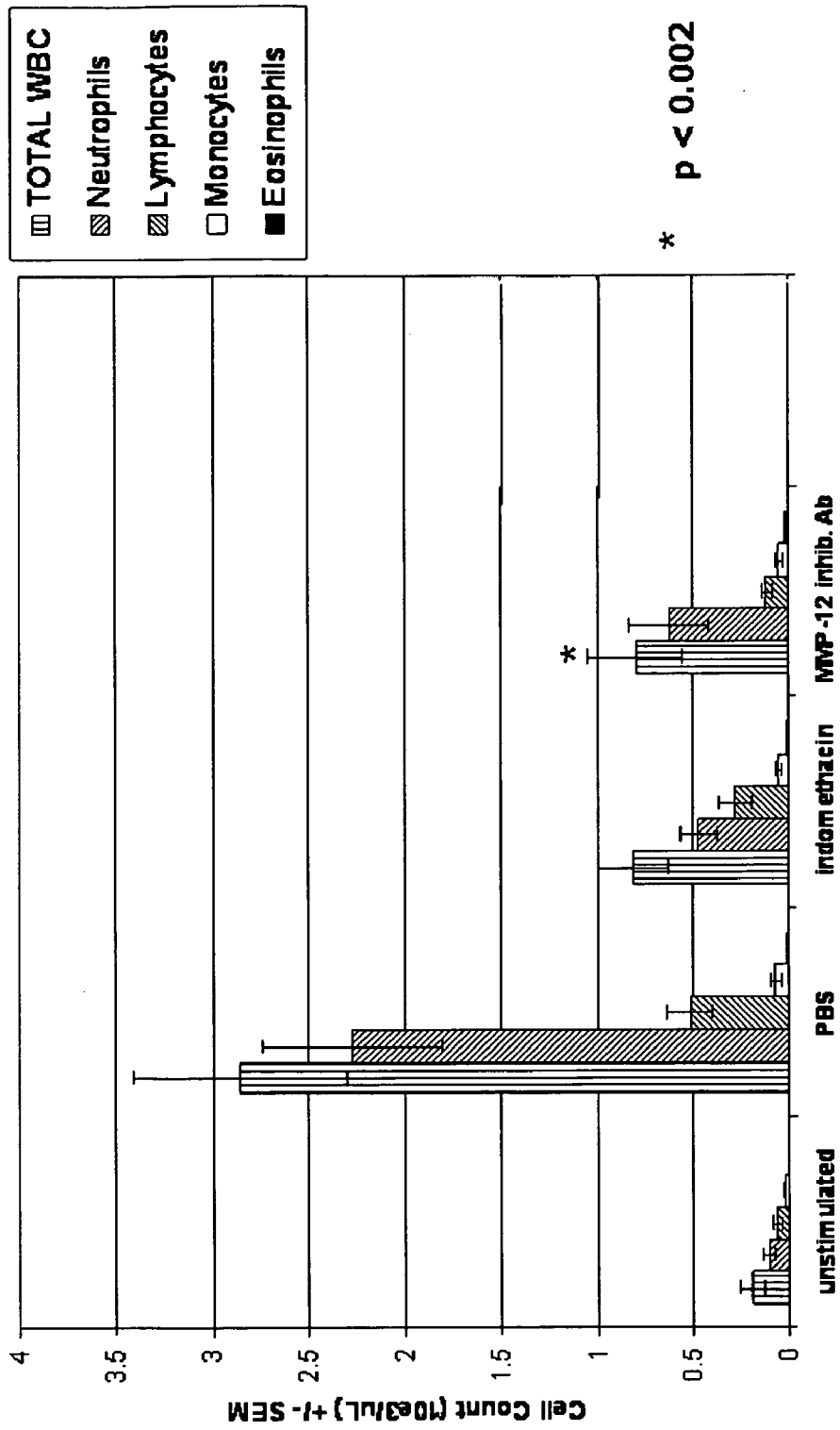
FIG. 8 is a bar graph showing the effect of an MMP-12 binding protein (M08-H09) on inflammatory cell infiltration into a carrageenan-stimulated mouse air pouch.

The effect of M08-H09 on inflammatory cell infiltration was compared to inflammatory cell infiltration indomethacin and a control (PBS). In addition, inflammatory cell recruitment was compared to an unstimulated mouse. As shown in FIG. 8, M08-H09 significantly decreased total white blood cell infiltration and specifically neutrophil and lymphocyte infiltration.

Example 3

Affinity Matured Variants of M08-H09

Table IX summarizes cycle 1 of the affinity maturation of M08-H09.

TABLE IX (The HV-CDR1 column discloses SEQ ID NOS 12-26 and the HV-CDR2 column discloses SEQ ID NOS 27-41):

| Initial Name | Selection method | HV-CDR1 | HV-CDR2 | N-Gly | Inhibition assays (sFAB) IC50hu (nM) | IC50 m | BIACORE (coated Fab) KD hu | koff m (1/s) |
|---|---|---|---|---|---|---|---|---|
| 539B-M0008-H09 |  | DYNMH | YIGPSGGYTHYADSVKG | 1 | 12.1 + 2.5 | <10 | 1.77E-08 | 4.00E-03 |
| 539B-M0063-B01 | straight human | WYWMG | SISPSGGYTFYADSVKG | 1 | 0.7 + 0.1 | >10 | 1.71E-10 | 2.50E-03 |
| 539B-M0063-B11 | straight human | PYWMH | GIGPSGGLTFYADSVKG | 1 | 0.7 + 0.1 | >10 | 1.20E-10 | 3.11E-03 |
| 539B-M0063-C07 | straight human | PYWMS | GISPSGGITFYADSVKG | 1 | 1.0 + 0.1 | <10 | 2.29E-09 | 2.00E-03 |
| 539B-M0063-G01 | straight human | WYWMV | SIGPSGGDTYYADSVKG | 1 | 0.8 + 0.1 | >10 | 1.58E-09 | 6.54E-03 |
| 539B-M0065-E12 | straight mouse | WYNMH | GISPSGGNTMYADSVKG | 1 | 1.4 + 0.1 | <10 | ND | ND |
| 539B-M0065-G03 | straight mouse | WYGMG | VIVSSGGFTQYADSVKG | 1 | 3.0 + 0.2 | <10 | ND | ND |
| 539B-M0065-H05 | straight mouse | YYGMG | VISSSGGFTFYADSVKG | 1 | 0.7 + 0.1 | ND | 2.19E-09 | ND |
| 539B-M0067-B06 | alternate | WYWMH | GIVSSGGTTIYADSVKG | 1 | 0.7 + 0.1 | <10 | 6.20E-10 | ND |
| 539B-M0067-F06 | alternate | WYNMS | RISPSGGDTGYADSVKG | 2 | 0.7 + 0.1 | <10 | 2.03E-10 | 2.50E-04 |
| 539B-M0069-C02 | TIMP + MMP12 | YYNMH | GIGPSGGGTLYADSVKG | 1 | 1.6 + 0.2 | ~10 | 6.97E-09 | ND |
| 539B-M0069-D10 | TIMP + MMP12 | LYHMH | GIGPSGGWTIYADSVKG | 1 | 2.3 + 0.1 | <10 | ND | ND |
| 539B-M0071-A01 | Lead + MMP12 | EYWMT | GISPSGGMTFYADSVKG | 1 | 0.3 + 0.1 | >10 | 1.10E-09 | 1.00E-02 |
| 539B-M0071-D09 | Lead + MMP12 | PYWMH | GISSSGGDTLYADSVKG | 1 | 2.4 + 0.2 | <10 | ND | ND |
| 539B-M0071-H03 | Lead + MMP12 | PYWMH | GIGPSGGPTFYADSIKG | 1 | 0.2 + 0.1 | <10 | 1.03E-09 | ND |

$KD_{hUMMP12}$ improvement ~10-100x
$Koff_{nMMP12}$ improvement ~2-10x

In cycle II of the affinity maturation, 109 Fabs were analyzed and 26 Fabs were selected as improved inhibitors. The $IC_{50}$ on human and murine MMP-12 was measured and an affinity ranking on human and murine MMP-12 was performed. For this analysis, 4 Fabs were selected and reformatted as IgGs. These four IgGs are described below in Table X:

TABLE X (SEQ ID NOS 42-46):

| Name | Specie | HC-CDR1 | HC-CDR2 | HC-CDR3 | Human MMP12 IC50 | Human MMP12 Kd (nM) | Human MMP12 off rate | Mouse MMP12 IC50 | Mouse MMP12 Kd (nM) | Mouse MMP12 off rate |
|---|---|---|---|---|---|---|---|---|---|---|
| M08-H09 | Fab | D Y N M H | Y I G P S G G Y T H Y A D S V K G D | I R G A Y S S S G L F D Y | 14 | 18 | 9.54E-03 | | | 4.00E-03 |
| M131 A06 | Fab | W Y ■ M H | ■ ■ ■ I P S C C ■ T ■ ■ Y A D S V K C D | D I V C P Y S A C L F D Y | 0.299 | 0.18 | 1.91E-04 | <10 | | 4.84E-05 |
| M121-C07 | Fab | W Y G M H | ■ I ■ S G G ■ T ■ T A D S V K G D | D I R G V F L S G L F D H | 0.008 | 0.197 | 1.41E-04 | <10 | | |
| M118-F11 | Fab | Y Y N M H | ■ I P S G G ■ T ■ T A D S V K G D | D I T G A Y S A G L F D L | 0.914 | 1.17 | 4.13E-04 | <10 | | 1.15E-04 |
| M130-C12 | Fab | K Y N M H | T I P S G G T H Y A D S V K G D | D T R G A Y S A G T F D Y | 0.688 | | | <10 | | 1.93E-04 |

Inhibition assays of the affinity matured clones were performed. The results are provided below in Table XI.

TABLE XI

| KD huMMP12 (nM) | | | 0.62 | 2.2 | 0.68 | 0.18 | 0.197 | 1.17 |
|---|---|---|---|---|---|---|---|---|
| | Dilution of enzyme | Substrate used | 539B-M067-B06 | 539B-M065-B05 | 539B-M130-C12 | 539B-M131-A06 | 539B-M121-E07 | 539B-M118-F11 |
| | | | IgG at 1 µM | IgG at 0.5 µM | Fab at 1 µM | Fab at 1 µM | Fab at 1 µM | Fab at 1 µM |
| hMMP1 | 1/300 | M-2350 | 99 | 121 | 125 | 159 | 148 | 133 |
| hMMP2 | 1/500 | M-2350 | 95 | 105 | 113 | 128 | 108 | 120 |
| hMMP3 | 1/200 | M-2225 | 104 | ND | 121 | 110 | 97 | 102 |
| hMMP7 | 1/500 | M-2350 | 102 | 128 | 117 | 115 | 113 | 112 |
| hMMP8 | 1/1000 | M-2350 | 106 | 114 | 131 | 107 | 107 | 127 |
| hMMP9 | 1/500 | M-2350 | 77 | 96 | 117 | 107 | 111 | 116 |
| hMMP10 | 1/100 | M-2350 | 109 | ND | 106 | 124 | 123 | 127 |
| hMMP12 | 1/500 | M-2350 | 0 | 0 | 0 | 2 | 3 | 1 |
| hMMP12 | 1/400 | M-2225 | 2 | ND | 1 | 0 | 0 | 0 |
| hMMP13 | 1/5000 | M-2350 | 102 | ND | 88 | 100 | 89 | 103 |
| hMMP14 | 1/1000 | M-2350 | 93 | ND | 135 | 120 | 143 | 124 |

539B-M131A06 was cross reactive with human and murine MMP-12. It has a IC50 or Ki of <0.3 nM and a KD of 180 µM for human MMP-12 and 73-150 µM for murine MMP-12.

Example 4

Figure 9:
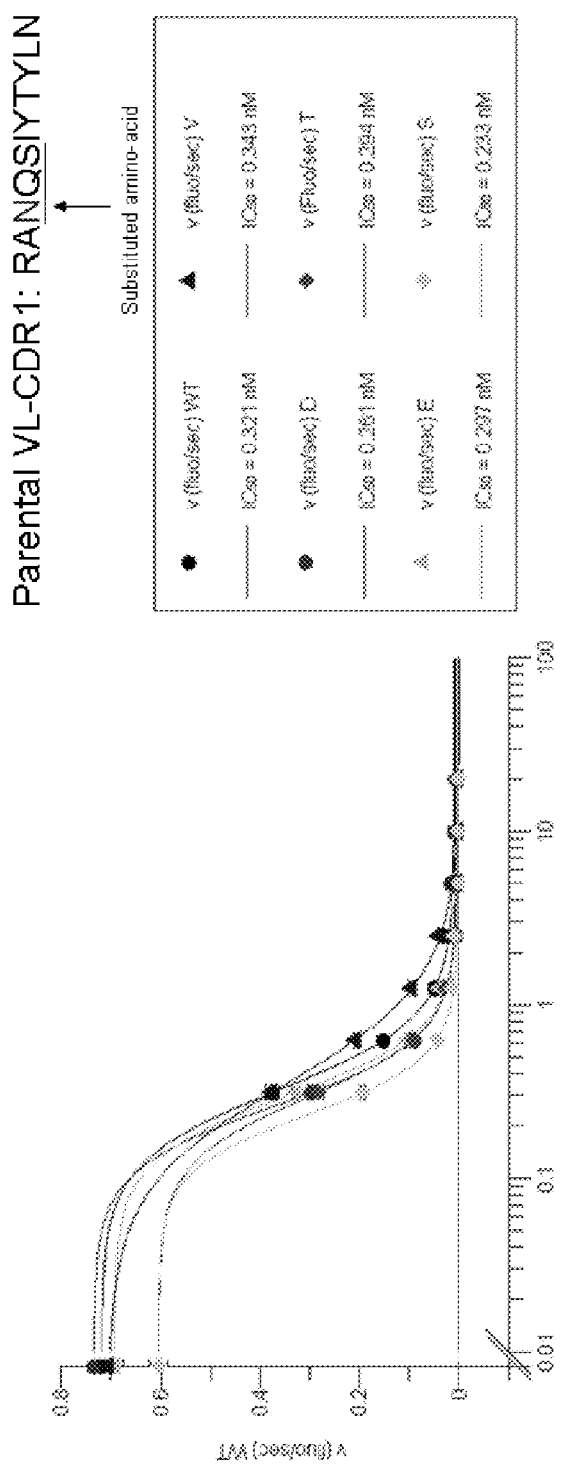
FIG. 9 is a line graph showing human MMP-12 activity (Fluo/sec) in the presence of increasing concentrations (nM) of an MMP-12 binding protein (539B-M131A06) and an MMP-12 binding protein (SEQ ID NO: 3,402) (539B-M131A06-GA-S) which is a version of 539B-M131A06 that has been modified to remove a glycosylation site.

Modification of 539B-M131-A06 (M131A06) to Remove a Glycosylation Site in CDR1 of the Variable Light Chain As shown in FIG. 9, CDR 1 of the variable light chain of M131A06 was modified to remove a glycosylation site. Removal of the glycosylation site in CDR1 did not effect binding of M131A06 to MMP-12. The MMP-12 antibody with the glycosylation site removed is referred to as 539B-M131A06-GA-S.

Example 5

FIG. 10 summarizes the identification of amino acid changes in affinity matured variant HV-CDRs (cycles 1 and 2) that contribute to improvement in affinity and inhibition properties.

TABLE XII

| DX number | SEQ ID NO. | Clone origin |
|---|---|---|
| DX-2712 | 47 | 539B-M0131-A06-GA-S |
| | 48 | 539B-M0008-H09-GA-S |
| | 49 | 539B-M0121-E07-GA-S |

TABLE XII-continued

| SEQ ID NO. | VL |
|---|---|
| 47 | DIQMTQSPSSLSASVGDRVTITCRASQSIYTYLNWYQQ KPGKAPKLLIYAASSLQSGVPSRFSGSGSGTDFTLTISS LQPEDFATYYCQQAGIFGQGTKLEIK |
| 48 | DIQMTQSPSSLSASVGDRVTITCRASQSIYTYLNWYQQ KPGKAPKLLIYAASSLQSGVPSRFSGSGSGTDFTLTISS LQPEDFATYYCQQAGIFGQGTKLEIK |
| 49 | DIQMTQSPSSLSASVGDRVTITCRASQSIYTYLNWYQQ KPGKAPKLLIYAASSLQSGVPSRFSGSGSGTDFTLTISS LQPEDFATYYCQQAGIFGQGTKLEIK |

| SEQ ID NO. | CL |
|---|---|
| 47 | RTVAAPSVFIFPPSDEQLKSGTASVVCLLNNFYPREAK VQWKVDNALQSGNSQESVTEQDSKDSTYSLSSTLTLSK ADYEKHKVYACEVTHQGLSSPVTKSFNRGEC |
| 48 | RTVAAPSVFIFPPSDEQLKSGTASVVCLLNNFYPREAK VQWKVDNALQSGNSQESVTEQDSKDSTYSLSSTLTLSK ADYEKHKVYACEVTHQGLSSPVTKSFNRGEC |
| 49 | RTVAAPSVFIFPPSDEQLKSGTASVVCLLNNFYPREAK VQWKVDNALQSGNSQESVTEQDSKDSTYSLSSTLTLSK ADYEKHKVYACEVTHQGLSSPVTKSFNRGEC |

| SEQ ID NO. | VH |
|---|---|
| 47 | EVQLLESGGGLVQPGGSLRLSCAASGFTFSWYWMHWV RQAPGKGLEWVSGISPSGGMTMYADSVKGRFTISRDN SKNTLYLQMNSLRAEDTAVYYCARDIVGPYSAGLFDY WGRGTLVTVSS |
| 48 | EVQLLESGGGLVQPGGSLRLSCAASGFTFSDYNMHWV RQAPGKGLEWVSYIGPSGGYTHYADSVKGRFTISRDN SKNTLYLQMNSLRAEDTAVYYCAKDIRGAYSSGLFDY WGRGTLVTVSS |

TABLE XII-continued

| 49 | EVQLLESGGGLVQPGGSLRLSCAASGFTFSWYGMHWV
RQAPGKGLEWVSGIVSSGGETFYADSVKGRFTISRDN
SKNTLYLQMNSLRAEDTAVYYCAKDIRGVFLSGLFDH
WGRGTLVTVSS |

| SEQ ID NO. | CH |
|---|---|
| 47 | ASTKGPSVFPLAPSSKSTSGGTAALGCLVKDYFPEPVT
VSWNSGALTSGVHTFPAVLQSSGLYSLSSVVTVPSSSL
GTQTYICNVNHKPSNTKVDKRVEPKSCDKTHTCPPCPA
PELLGGPSVFLFPPKPKDTLMI
SRTPEVTCVVVDVSHEDPEVKFNWYVDGVEVHNAKTKP
REEQYNSTYRVVSVLTVLHQDWLNGKEYKCKVSNKALP
APIEKTISKAKGQPREPQVYTLPPSREEMTKNQVSLTC
LVKGFYPSDIAVEWESNGQPEN
NYKTTPPVLDSDGSFFLYSKLTVDKSRWQQGNVFSCSV
MHEALHNHYTQKSLSLSPGK |
| 48 | ASTKGPSVFPLAPSSKSTSGGTAALGCLVKDYFPEPVT
VSWNSGALTSGVHTFPAVLQSSGLYSLSSVVTVPSSSL
GTQTYICNVNHKPSNTKVDKRVEPKSCDKTHTCPPCPA
PELLGGPSVFLFPPKPKDTLMIS
RTPEVTCVVVDVSHEDPEVKFNWYVDGVEVHNAKTKPR
EEQYNSTYRVVSVLTVLHQDWLNGKEYKCKVSNKALPA
PIEKTISKAKGQPREPQVYTLPPSREEMTKNQVSLTCL
VKGFYPSDIAVEWESNGQPEN
NYKTTPPVLDSDGSFFLYSKLTVDKSRWQQGNVFSCSV
MHEALHNHYTQKSLSLSPGK |
| 49 | ASTKGPSVFPLAPSSKSTSGGTAALGCLVKDYFPEPVT
VSWNSGALTSGVHTFPAVLQSSGLYSLSSVVTVPSSSL
GTQTYICNVNHKPSNTKVDKRVEPKSCDKTHTCPPCPA
PELLGGPSVFLFPPKPKDTLMI
SRTPEVTCVVVDVSHEDPEVKFNWYVDGVEVHNAKTKP
REEQYNSTYRVVSVLTVLHQDWLNGKEYKCKVSNKALP
APIEKTISKAKGQPREPQVYTLPPSREEMTKNQVSLTC
LVKGFYPSDIAVEWESNGQPEN
NYKTTPPVLDSDGSFFLYSKLTVDKSRWQQGNVFSCSV
MHEALHNHYTQKSLSLSPGK |

Cycle 1 Fab Inhibitor Sequences-Light Chain.

| Initial Name | LV-FR1 (SEQ ID NOS 50-83) | LV-CDR1 (SEQ ID NOS 84-117) | LV-FR2 (SEQ ID NOS 118-151) | LV-CDR2 (SEQ ID NOS 152-185) | LV-FR3 (SEQ ID NOS 186-219) | LV-CDR3 (SEQ ID NOS 220-253) | LV-FR4 (SEQ ID NOS 254-287) | L-Constant (SEQ ID NOS 288-321) |
|---|---|---|---|---|---|---|---|---|
| 539B-M0063-A02 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0063-A04 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0063-B01 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0063-B11 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0063-C07 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0063-G01 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 5398-M0065-E12 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0065-G03 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0065-H05 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0067-A02 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0067-B06 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0067-B09 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0067-C10 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0067-F02 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0067-F06 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0069-A04 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |

| Initial Name | LV-FR1 (SEQ ID NOS 50-83) | LV-CDR1 (SEQ ID NOS 84-117) | LV-FR2 (SEQ ID NOS 118-151) | LV-CDR2 (SEQ ID NOS 152-185) | LV-FR3 (SEQ ID NOS 186-219) | LV-CDR3 (SEQ ID NOS 220-253) | LV-FR4 (SEQ ID NOS 254-287) | L-Constant (SEQ ID NOS 288-321) |
|---|---|---|---|---|---|---|---|---|
| 539B-M0069-A11 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0069-C02 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0069-D10 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0069-G07 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0071-A01 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0071-B07 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0071-D05 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0071-D09 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0071-H03 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0071-H06 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0087-F09 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0088-F07 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0088-G10 | QDIQMTQSPSSL SASVGDRVTITC | RASQSIS SYLN | WYQQKPGKAPE LLIY | AASSLQS | GVPSRFSGSGSGTDFT LTISSLQPEDFATYYC | QQSYSTP RT | FGQGTKLEIK | RTVAAPS |
| 539B-M0088-H10 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0089-C01 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0089-F05 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |
| 539B-M0089-B07 | QDIQMTqSPGTL SLSPGERATMSC | RASQSFT GSYLA | WYQQKPGLAPR LLIY | DASSRAA | GIPDRFSGSGSGTDFT LTISRLEPEDFAVYYC | QQYGTSP PWA | FGQGTKVEIK | RTVAAPS |
| 539B-M0089-H11 | QDIQMTQSPSSL SASVGDRVTITC | RANQSIY TYLN | WYQQKPGKAPE LLIY | AASSLQS | GVPSRFSGSGSGTDFT LTISSLQPEDFATYYC | QQAGI | FGQGTKLEIK | RTVAAPS |

Cycle 1 Fab Inhibitor Sequences-Heavy Chain Variable Region (Clones are in Same Order as Provided Above for the Light Chain Sequences)

| HV-FR1 (SEQ ID NOS 322-355) | HV-CDR1 (SEQ ID NOS 356-389) | HV-FR2 (SEQ ID NOS 390-423) | HV-CDR2 (SEQ ID NOS 424-457) | HV-FR3 (SEQ ID NOS 458-491) | HV-CDR3 (SEQ ID NOS 492-525) | HV-FR4 (SEQ ID NOS 526-559) |
|---|---|---|---|---|---|---|
| EVQLLESGGGLVQPG GSLRLSCAASGFTFS | QYWMG | WVRQAPGKGLEWVS | SISPSGGMTMY ADSVKG | RFTISRDNSKNTLYLQ MNSLRAEDTAVYYCAK | DIRGAYSSGLFDY | WGRGTLVTVSS |
| EVQLLESGGGLVQPG GSLRLSCAASGFTFS | DYGMA | WVRQAPGKGLEWVS | SISPSGGWTLY ADSVKG | RFTISRDNSKNTLYLQ MNSLRAEDTAVYYCAK | DIRGAYSSGLFDY | WGRGTLVTVSS |
| EVQLLESGGGLVQPG GSLRLSCAASGFTFS | WYWMG | WVRQAPGKGLEWVS | SISPSGGYTFY ADSVKG | RFTISRDNSKNTLYLQ MNSLRAEDTAVYYCAK | DIRGAYSSGLFDY | WGRGTLVTVSS |

-continued

| | | | | | | |
|---|---|---|---|---|---|---|
| EVQLLESGGGLVQPGGSLRLSCAASGFTFS | PYWMH | WVRQAPGKGLEWVS | GIGPSGGLTFYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | PYWMS | WVRQAPGKGLEWVS | GISPSGGITFYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | WYWMV | WVRQAPGKGLEWVS | SIGPSGGDTYYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | WYNMH | WVRQAPGKGLEWVS | GISPSGGNTMYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | WYGMG | WVRQAPGKGLEWVS | VIVSSGGFTQYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | YYGMG | WVRQAPGKGLEWVS | VISSSGGFTFYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | QYWMS | WVRQAPGKGLEWVS | SISPSGGETFYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | WYWMH | WVRQAPGKGLEWVS | GIVSSGGTTIYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | RYNMH | WVRQAPGKGLEWVS | GIVPSGGTTHYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | VYGMS | WVRQAPGKGLEWVS | RIVPSGGRTGYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | EYWMA | WVRQAPGKGLEWVS | SISPSGGHTFYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | WYNMS | WVRQAPGKGLEWVS | RISPSGGDTGYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | EYWMG | WVRQAPGKGLEWVS | SIYPSGGNTIYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | YYNMS | WVRQAPGKGLEWVS | GISPSGGPTGYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | YYNMH | WVRQAPGKGLEWVS | GIGPSGGGTLYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | LYHMH | WVRQAPGKGLEWVS | GIGPSGGWTIYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | EYNMH | WVRQAPGKGLEWVS | GISPSGGMTHYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | EYWMT | WVRQAPGKGLEWVS | GISPSGGMTFYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | HYWMH | WVRQAPGKGLEWVS | GISPSGGMTMYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | QYNMH | WVRQAPGKGLEWVS | GIGPSGGITIYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | PYWMH | WVRQAPGKGLEWVS | GISSSGGDTLYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | PYWMH | WVRQAPGKGLEWVS | GIGPSGGPTFYADSIKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | AYGMS | WVRQAPGKGLEWVS | RISPSGGITGYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | WYYMG | WVRQAPGKGLEWVS | SISPSGGWTRYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | FYWMD | WVRQAPGKGLEWVS | SISPSGGTTIYADSVKG | RFTISRDNSKNTLYLQMNSLRAEDTAVYYCAK | DIRGAYSSGLFDY | WGRGTLVTVSS |
| EVQLLESGGGLVQPGGSLRLSCAASGFTFS | DYNMH | WVRQAPGKGLEWVS | YIGPSGGYTHYADSVKG | RFTISRDNSKNTLYLQMNSLRAEDTAVYYCAK | DIRGAYSSGLFDY | WGRGTLVTVSS |

-continued

| | | | | | | | |
|---|---|---|---|---|---|---|---|
| EVQLLESGGGLVQPG GSLRLSCAASGFTFS | WYWMV | WVRQAPGKGLEWVS | SIVPSGGFTIY ADSVKG | RFTISRDNSKNTLYLQ MNSLRAEDTAVYYCAK | DIRGAYSSGLFDY | WGRGTLVTVSS | |
| EVQLLESGGGLVQPG GSLRLSCAASGFTFS | RYMMH | WVRQAPGKGLEWVS | YISSSGGTTIY ADSVKG | RFTISRDNSKNTLYLQ MNSLRAEDTAVYYCAK | DIRGAYSSGLFDY | WGRGTLVTVSS | |
| EVQLLESGGGLVQPG GSLRLSCAASGFTFS | HYWMQ | WVRQAPGKGLEWVS | GIVPSGGLTMY ADSVKG | RFTISRDNSKNTLYLQ MNSLRAEDTAVYYCAK | DIRGAYSSGLFDY | WGRGTLVTVSS | |
| EVQLLESGGGLVQPG GSLRLSCAASGFTFS | DYNMH | WVRQAPGKGLEWVS | YIGPSGGYTHY ADSVKG | RFTISRDNSKNTLYLQ MNSLRAEDTAVYYCAK | DIRGAYSSGLFDY | WGRGTLVTVSS | |
| EVQLLESGGGLVQPG GSLRLSCAASGFTFS | DYWMA | WVRQAPGKGLEWVS | SIGPSGGFTVY ADSVKG | RFTISRDNSKNTLYLQ MNSLRAEDTAVYYCAK | DIRGAYSSGLFDY | WGRGTLVTVSS | |

| Mutants VH-CDR1 | LV-FR1 (SEQ ID NOS 560-562) | LV-CDR1 (SEQ ID NOS 563-565) | LV-FR2 (SEQ ID NOS 566-568) | LV-CDR2 (SEQ ID NOS 569-571) | LV-FR3 (SEQ ID NOS 572-574) | LV-CDR3 (SEQ ID NOS 575-577) | LV-FR4 (SEQ ID NOS 578-580) | LC (SEQ ID NOS 581-583) |
|---|---|---|---|---|---|---|---|---|
| 539B-M0067-F06-A | QDIQMTQSPSSL SASVGDRVTITC | RANQSIYTYLN | WYQQKPGKA PELLIY | AASSLQS | GVPSRFSGSGSGTDFT LTISSLQPEDFATYYC | QQAGI | FGQGTKL EIK | RTVAAPS |
| 539B-M0067-F06-G | QDIQMTQSPSSL SASVGDRVTITC | RANQSIYTYLN | WYQQKPGKA PELLIY | AASSLQS | GVPSRFSGSGSGTDFT LTISSLQPEDFATYYC | QQAGI | FGQGTKL EIK | RTVAAPS |
| 539B-M0067-F06-V | QDIQMTQSPSSL SASVGDRVTITC | RANQSIYTYLN | WYQQKPGKA PELLIY | AASSLQS | GVPSRFSGSGSGTDFT LTISSLQPEDFATYYC | QQAGI | FGQGTKL EIK | RTVAAPS |

These heavy chain mutant sequences are in the same order as the light chain designations provided above

| Mutants Leader (SEQ ID NOS 584-586) | HV-FR1 (SEQ ID NOS 587-589) | HV-CDR1 (SEQ ID NOS 590-592) | HV-FR2 (SEQ ID NOS 593-595) | HV-CDR2 (SEQ ID NOS 596-598) | HV-FR3 (SEQ ID NOS 599-601) | HV-CDR3 (SEQ ID NOS 602-604) | HV-FR4 (SEQ ID NOS 605-607) |
|---|---|---|---|---|---|---|---|
| MKKLLFAIPLV VPFVAQAMA | EVQLLESGGGLVQPG GSLRLSCAASGFTFS | WYNMA | WVRQAPGKGLE WVS | RISPSGGDTGY ADSVKG | RFTISRDNSKNTLYLQ MNSLRAEDTAVYYCAK | DIRGAYSSGL FDY | WGRGTLVTVSS |
| MKKLLFAIPLV VPFVAQAMA | EVQLLESGGGLVQPG GSLRLSCAASGFTFS | WYNMG | WVRQAPGKGLE WVS | RISPSGGDTGY ADSVKG | RFTISRDNSKNTLYLQ MNSLRAEDTAVYYCAK | DIRGAYSSGL FDY | WGRGTLVTVSS |
| MKKLLFAIPLV VPFVAQAMA | EVQLLESGGGLVQPG GSLRLSCAASGFTFS | WYNMG | WVRQAPGKGLE WVS | RISPSGGDTGY ADSVKG | RFTISRDNSKNTLYLQ MNSLRAEDTAVYYCAK | DIRGAYSSGL FDY | WGRGTLVTVSS |

LV-AA (SEQ ID NOS 608-641)

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

-continued

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQ
GTKVEIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

QDIQMTqSPGTLSLSPGERATMSCRASQSFTGSYLAWYQQKPGLAPRLLIYDASSRAAGIPDRFSGSGSGTDFTLTISRLEPEDFAVYYCQQYGTSPPWAF
GQGTKVEIK

QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKL
EIK

HV-AA (SEQ ID NOS 642-675)

EVQLLESGGGLVQPGGSLRLSCAASGFTFSQYWMGWVRQAPGKGLEWVSSISPSGGMTYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSDYGMAWVRQAPGKGLEWVSSISPSGGWTLYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSWYWMGWVRQAPGKGLEWVSSISPSGGYTFYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSPYWMHWVRQAPGKGLEWVSGIGPSGGLTFYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSPYWMSWVRQAPGKGLEWVSGISPSGGITFYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSWYWMVWVRQAPGKGLEWVSSIGPSGGDTYYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSWYNMHWVRQAPGKGLEWVSGISPSGGNTMYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSWYGMGWVRQAPGKGLEWVSVIVSSGGFTQYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSYYGMGWVRQAPGKGLEWVSVISSSGGFTFYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSQYWMSWVRQAPGKGLEWVSSISPSGGETFYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSWYWMHWVRQAPGKGLEWVSGIVSSGGTTIYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSRYNMHWVRQAPGKGLEWVSGIVPSGGTTHYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSVYGMSWVRQAPGKGLEWVSRIVPSGGRTGYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSEYWMAWVRQAPGKGLEWVSSISPSGGHTFYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSWYNMSWVRQAPGKGLEWVSRISPSGGDTGYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSEYWMGWVRQAPGKGLEWVSSIYPSGGNTIYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSYYNMSWVRQAPGKGLEWVSGISPSGGPTGYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSYYNMHWVRQAPGKGLEWVSGIGPSGGGTLYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSLYHMHWVRQAPGKGLEWVSGIGPSGGWTIYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSEYNMHWVRQAPGKGLEWVSGISPSGGMTHYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSEYWMTWVRQAPGKGLEWVSGISPSGGMTFYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSHYWMHWVRQAPGKGLEWVSGISPSGGMTMYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSQYNMHWVRQAPGKGLEWVSGIGPSGGITIYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSPYWMHWVRQAPGKGLEWVSGISSSGGDTLYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSPYWMHWVRQAPGKGLEWVSGIGPSGGPTFYADSIKGRFTISRDNSKNTLYLQMNSLRAEDTAVYYCAKDIR
GAYSSGLFDYWGRGTLVTVSS

EVQLLESGGGLVQPGGSLRLSCAASGFTFSAYGMSWVRQAPGKGLEWVSRISPSGGITGYADSVKGRFTISRDNSKNTLYLQMNSLRAEDTAVYYCAKDIR
GAYSSGLFDYWGRGTLVTVSS

```
EVQLLESGGGLVQPGGSLRLSCAASGFTFSWYYMGWVRQAPGKGLEWVSSISPSGGWTRYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSFYWMDWVRQAPGKGLEWVSSISPSGGTTIYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSDYNMHWVRQAPGKGLEWVSYIGPSGGYTHYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSWYWMVWVRQAPGKGLEWVSSIVPSGGFTIYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSRYMMHWVRQAPGKGLEWVSYISSSGGTTIYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSHYWMQWVRQAPGKGLEWVSGIVPSGGLTMYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSDYNMHWVRQAPGKGLEWVSYIGPSGGYTHYADSVKGRFTISRDNSKNTLYLQMNSLRAEDTAVYYCAKDIR
GAYSSGLFDYWGRGTLVTVSS

EVQLLESGGGLVQPGGSLRLSCAASGFTFSDYWMAWVRQAPGKGLEWVSSIGPSGGFTVYADSVKGRFTISRDNSKNTLYLQMNSLRAEDTAVYYCAKDIR
GAYSSGLFDYWGRGTLVTVSS
```

Cycle 2 Inhibitors-Light Chain Variable Region Sequences

| Initial Name | LV-FR1 (SEQ ID NOS 676-700) | LV-CDR1 (SEQ ID NOS 701-725) | LV-FR2 (SEQ ID NOS 726-750) | LV-CDR2 (SEQ ID NOS 751-775) | LV-FR3 (SEQ ID NOS 776-800) | LV-CDR3 (SEQ ID NOS 801-821) | LV-FR4 (SEQ ID NOS 826-850) |
|---|---|---|---|---|---|---|---|
| 539B-M0105-C05 | QDIQMTQSPSSLSASVGDRVTITC | RANQSIYTYLN | WYQQKPGKAPELLIY | AASSLQS | GVPSRFSGSGSGTDFTLTISSLQPEDFATYYC | QQAGI | FGQGTKLEIK |
| 539B-M0105-E11 | QDIQMTQSPSSLSASVGDRVTITC | RANQSIYTYLN | WYQQKPGKAPELLIY | AASSLQS | GVPSRFSGSGSGTDFTLTISSLQPEDFATYYC | QQAGI | FGQGTKLEIK |
| 539B-M0105-F08 | QDIQMTQSPSSLSASVGDRVTITC | RANQSIYTYLN | WYQQKPGKAPELLIY | AASSLQS | GVPSRFSGSGSGTDFTLTISSLQPEDFATYYC | QQAGI | FGQGTKLEIK |
| 539B-M0107-A12 | QDIQMTQSPSSLSASVGDRVTITC | RANQSIYTYLN | WYQQKPGKAPELLIY | AASSLQS | GVPSRFSGSGSGTDFTLTISSLQPEDFATYYC | QQAGI | FGQGTKLEIK |
| 539B-M0108-A02 | QDIQMTQSPSSLSASVGDRVTITC | RANQSIYTYLN | WYQQKPGKAPELLIY | AASSLQS | GVPSRFSGSGSGTDFTLTISSLQPEDFATYYC | QQAGI | FGQGTKLEIK |
| 539B-M0109-G11 | QDIQMTQSPSSLSASVGDRVTITC | RANQSIYTYLN | WYQQKPGKAPELLIY | AASSLQS | GVPSRFSGSGSGTDFTLTISSLQPEDFATYYC | QQAGI | FGQGTKLEIK |
| 539B-M0110-G05 | QDIQMTQSPSSLSASVGDRVTITC | RANQSIYTYLN | WYQQKPGKAPELLIY | AASSLQS | GVPSRFSGSGSGTDFTLTISSLQPEDFATYYC | QQAGI | FGQGTKLEIK |
| 539B-M0129-B11 | QDIQMTQSPSSLSASVGDRVTITC | RANQSIYTYLN | WYQQKPGKAPELLIY | AASSLQS | GVPSRFSGSGSGTDFTLTISSLQPEDFATYYC | QQAGI | FGQGTKLEIK |
| 539B-M0130-A01 | QDIQMTQSPSSLSASVGDRVTITC | RANQSIYTYLN | WYQQKPGKAPELLIY | AASSLQS | GVPSRFSGSGSGTDFTLTISSLQPEDFATYYC | QQAGI | FGQGTKLEIK |
| 539B-M0130-C12 | QDIQMTQSPSSLSASVGDRVTITC | RANQSIYTYLN | WYQQKPGKAPELLIY | AASSLQS | GVPSRFSGSGSGTDFTLTISSLQPEDFATYYC | QQAGI | FGQGTKLEIK |
| 539B-M0130-F06 | QDIQMTQSPSSLSASVGDRVTITC | RANQSIYTYLN | WYQQKPGKAPELLIY | AASSLQS | GVPSRFSGSGSGTDFTLTISSLQPEDFATYYC | QQAGI | FGQGTKLEIK |
| 539B-M0130-H04 | QDIQMTQSPSSLSASVGDRVTITC | RANQSIYTYLN | WYQQKPGKAPELLIY | AASSLQS | GVPSRFSGSGSGTDFTLTISSLQPEDFATYYC | QQAGI | FGQGTKLEIK |
| 539B-M0131-A06 | QDIQMTQSPSSLSASVGDRVTITC | RANQSIYTYLN | WYQQKPGKAPELLIY | AASSLQS | GVPSRFSGSGSGTDFTLTISSLQPEDFATYYC | QQAGI | FGQGTKLEIK |
| 539B-M0131-D03 | QDIQMTQSPSSLSASVGDRVTITC | RANQSIYTYLN | WYQQKPGKAPELLIY | AASSLQS | GVPSRFSGSGSGTDFTLTISSLQPEDFATYYC | QQAGI | FGQGTKLEIK |
| 539B-M0132-A04 | QDIQMTQSPSSLSASVGDRVTITC | RANQSIYTYLN | WYQQKPGKAPELLIY | AASSLQS | GVPSRFSGSGSGTDFTLTISSLQPEDFATYYC | QQAGI | FGQGTKLEIK |

-continued

| Initial Name | LV-FR1 (SEQ ID NOS 676-700) | LV-CDR1 (SEQ ID NOS 701-725) | LV-FR2 (SEQ ID NOS 726-750) | LV-CDR2 (SEQ ID NOS 751-775) | LV-FR3 (SEQ ID NOS 776-800) | LV-CDR3 (SEQ ID NOS 801-821) | LV-FR4 (SEQ ID NOS 826-850) |
|---|---|---|---|---|---|---|---|
| 539B-M0133-B08 | QDIQMTQSPSSL SASVGDRVTITC | RANQSIYTYLN | WYQQKPGKAPE LLIY | AASSLQS | GVPSRFSGSGSGTDFT LTISSLQPEDFATYYC | QQAGI | FGQGTKLEIK |
| 539B-M0133-E05 | QDIQMTQSPSSL SASVGDRVTITC | RANQSIYTYLN | WYQQKPGKAPE LLIY | AASSLQS | GVPSRFSGSGSGTDFT LTISSLQPEDFATYYC | QQAGI | FGQGTKLEIK |
| 539B-M0121-E07 | QDIQMTQSPSSL SASVGDRVTITC | RANQSIYTYLN | WYQQKPGKAPE LLIY | AASSLQS | GVPSRFSGSGSGTDFT LTISSLQPEDFATYYC | QQAGI | FGQGTKLEIK |
| 539B-M0118-F11 | QDIQMTQSPSSL SASVGDRVTITC | RANQSIYTYLN | WYQQKPGKAPE LLIY | AASSLQS | GVPSRFSGSGSGTDFT LTISSLQPEDFATYYC | QQAGI | FGQGTKLEIK |
| 539B-M0125-G07 | QDIQMTQSPSSL SASVGDRVTITC | RANQSIYTYLN | WYQQKPGKAPE LLIY | AASSLQS | GVPSRFSGSGSGTDFT LTISSLQPEDFATYYC | QQAGI | FGQGTKLEIK |
| 539B-M0124-E07 | QDIQMTQSPSSL SASVGDRVTITC | RANQSIYTYLN | WYQQKPGKAPE LLIY | AASSLQS | GVPSRFSGSGSGTDFT LTISSLQPEDFATYYC | QQAGI | FGQGTKLEIK |
| 539B-M0119-D01 | QDIQMTQSPSSL SASVGDRVTITC | RANQSIYTYLN | WYQQKPGKAPE LLIY | AASSLQS | GVPSRFSGSGSGTDFT LTISSLQPEDFATYYC | QQAGI | FGQGTKLEIK |
| 539B-M0119-A02 | QDIQMTQSPSSL SASVGDRVTITC | RANQSIYTYLN | WYQQKPGKAPE LLIY | AASSLQS | GVPSRFSGSGSGTDFT LTISSLQPEDFATYYC | QQAGI | FGQGTKLEIK |
| 539B-M0122-C06 | QDIQMTQSPSSL SASVGDRVTITC | RANQSIYTYLN | WYQQKPGKAPE LLIY | AASSLQS | GVPSRFSGSGSGTDFT LTISSLQPEDFATYYC | QQAGI | FGQGTKLEIK |
| 539B-M0123-G07 | QDIQMTQSPSSL SASVGDRVTITC | RANQSIYTYLN | WYQQKPGKAPE LLIY | AASSLQS | GVPSRFSGSGSGTDFT LTISSLQPEDFATYYC | QQAGI | FGQGTKLEIK |

Cycle 2 Inhibitors-Heavy Chain Variable Sequences
(These are in the Same Order as the Cycle 2 Light Chain Inhibitors Provided Above)

| HV-FR1 (SEQ ID NOS 851-875) | HV-CDR1 (SEQ ID NOS 876-900) | HV-FR2 (SEQ ID NOS 901-925) | HV-CDR2 (SEQ ID NOS 926-950) | HV-FR3 (SEQ ID NOS 951-975) | HV-CDR3 (SEQ ID NOS 976-1000) | HV-FR4 (SEQ ID NOS 1001-1025) |
|---|---|---|---|---|---|---|
| EVQLLESGGGLVQPG GSLRLSCAASGFTFS | PYWMH | WVRQAPGKGLEWVS | GISSSGGDTLYADSVKG | RFTISRDNSKNTLYLQ MNGLRAEDTAVYYCAR | DIRGAYSS GLFFS | WGRGTLVTVSS |
| EVQLLESGGGLVQPG GSLRLSCAASGFTFS | QYFMH | WVRQAPGKGLEWVS | GIYPSGGDTFYADSVKG | RFTISRDNSKNTLYLQ MNSLRAEDTAVYYCAR | DIRGAYSS GVFDY | WGRGTLVTVSS |
| EVQLLESGGGLVQPG GSLRLSCAASGFTFS | PYWMH | WVRQAPGKGLEWVS | GISSSGGDTLYADSVKG | RFTISRDNSKNTLYLQ MNGLRAEDTAVYYCAR | DIRGAYSS GLFFS | WGRGTLVTVSS |
| EVQLLESGGGLVQPG GSLRLSCAASGFTFS | DYNMH | WVRQAPGKGLEWVS | YIGPSGGYTHYADSVKG | RFTISRDNSKNTLYLQ MNSLRAEDTAVYYCAR | DIRGAYAS GLFDY | WGRGTLVTVSS |
| EVQLLESGGGLVQPG GSLRLSCAASGFTFS | WYWMH | WVRQAPGKGLEWVS | GIYSSGGDTIYADSVKG | RFTISRDNSKNTLYLQ MNSLRAEDTAVYYCAK | DIRGPHSS GLFDY | WGRGTLVTVSS |
| EVQLLESGGGLVQPG GSLRLSCAASGFTFS | EYNMH | WVRQAPGKGLEWVS | GIVPSGGLTHYADSVKG | RFTISRDNSKNTLYLQ MNSLRAEDTAVYYCAK | DIRGAYSS GLFDY | WGRGTLVTVSS |
| EVQLLESGGGLVQPG GSLRLSCAASGFTFS | EYNMH | WVRQAPGKGLEWVS | GIGPSGGPTMYADSVKG | RFTISRDNSKNTLYLQ MNSLRAEDTAVYYCAK | DIRGAYSG GLFDY | WGRGTLVTVSS |
| EVQLLESGGGLVQPG GSLRLSCAASGFTFS | PYWMH | WVRQAPGKGLEWVS | GIGPSGGPTFYADSVKG | RFTISRDNSKNTLYLQ MNSLRAEDTAVYYCAR | DIMGAYAS GLFHN | WGRGTLVTVSS |
| EVQLLESGGGLVQPG GSLRLSCAASGFTFS | EYNMH | WVRQAPGKGLEWVS | GIVPSGGLTHYADSVKG | RFTISRDNSKNTLYLQ MNSLRAEDTAVYYCAK | DIRGAYSS GLFDH | WGRGTLVTVSS |
| EVQLLESGGGLVQPG GSLRLSCAASGFTFS | EYNMH | WVRQAPGKGLEWVS | GIVPSGGLTHYADSVKG | RFTISRDNSKNTLYLQ MNSLRAEDTAVYYCAR | DIRGAYSA GIFDY | WGRGTLVTVSS |

| HV-FR1 (SEQ ID NOS 851-875) | HV-CDR1 (SEQ ID NOS 876-900) | HV-FR2 (SEQ ID NOS 901-925) | HV-CDR2 (SEQ ID NOS 926-950) | HV-FR3 (SEQ ID NOS 951-975) | HV-CDR3 (SEQ ID NOS 976-1000) | HV-FR4 (SEQ ID NOS 1001-1025) |
|---|---|---|---|---|---|---|
| EVQLLESGGGLVQPGGSLRLSCAASGFTFS | PYWMH | WVRQAPGKGLEWVS | GISPSGGETIYADSVKG | RFTISRDNSKNTLYLQMNSLRAEDTAVYYCAR | DIWGAYSAGHFEY | WGRGTLVTVSS |
| EVQLLESGGGLVQPGGSLRLSCAASGFTFS | PYWMH | WVRQAPGKGLEWVS | GISPSGGHTMYADSVKG | RFTISRDNSKNTLYLQMNSLRAEDTAVYYCAK | DIRGAYSSGLFDF | WGRGTLVTVSS |
| EVQLLESGGGLVQPGGSLRLSCAASGFTFS | WYWMH | WVRQAPGKGLEWVS | GISPSGGMTMYADSVKG | RFTISRDNSKNTLYLQMNSLRAEDTAVYYCAR | DIVGPYSAGLFDY | WGRGTLVTVSS |
| EVQLLESGGGLVQPGGSLRLSCAASGFTFS | WYWMH | WVRQAPGKGLEWVS | GISPSGGYTMYADSVKG | RFTISRDNSKNTLYLQMNSLRAEDTAVYYCAK | DISGAYSSGLFTF | WGRGTLVTVSS |
| EVQLLESGGGLVQPGGSLRLSCAASGFTFS | PYWMH | WVRQAPGKGLEWVS | GISPSGGNTLYADSVKG | RFTISRDNSKNTLYLQMNSLRAEDTAVYYCAR | DIRGAYSSGLFYD | WGRGTLVTVSS |
| EVQLLESGGGLVQPGGSLRLSCAASGFTFS | WYWMH | WVRQAPGKGLEWVS | GISPSGGSTFYADSVKG | RFTISRDNSKNTLYLQMNSLRAEDTAVYYCAR | DFSGAYSAGLFAY | WGRGTLVTVSS |
| EVQLLESGGGLVQPGGSLRLSCAASGFTFS | YYNMH | WVRQAPGKGLEWVS | GIGPSGGGTLYADSVKG | RFTISRDNSKNTLYLQMNSLRAEDTAVYYCAR | DLSGEYASGLFGY | WGRGTLVTVSS |
| EVQLLESGGGLVQPGGSLRLSCAASGFTFS | WYGMH | WVRQAPGKGLEWVS | GIVSSGGETFYADSVKG | RFTISRDNSKNTLYLQMNSLRAEDTAVYYCAK | DIRGVFLSGLFDH | WGRGTLVTVSS |
| EVQLLESGGGLVQPGGSLRLSCAASGFTFS | YYNMH | WVRQAPGKGLEWVS | GISPSGGTTFYADSVKG | RFTISRDNSKNTLYLQMNSLRAEDTAVYYCAR | DITGAYSAGLFDL | WGRGTLVTVSS |
| EVQLLESGGGLVQPGGSLRLSCAASGFTFS | PYNMH | WVRQAPGKGLEWVS | GISPSGGNTMYADSVKG | RFTISRDNSKNTLYLQMNSLRAEDTAVYYCAR | DIWGAYASGLFDY | WGRGTLVTVSS |
| EVQLLESGGGLVQPGGSLRLSCAASGFTFS | PYWMH | WVRQAPGKGLEWVS | GISPSGGWTFYADSVKG | RFTISRDNSKNTLYLQMNSLRAEDTAVYYCAR | DIRGAYSSGMFDF | WGRGTLVTVSS |
| EVQLLESGGGLVQPGGSLRLSCAASGFTFS | PYWMH | WVRQAPGKGLEWVS | GIGPSGGPTFYADSVKG | RFTISRDNSKNTLYLQMNSLRAEDTAVYYCAK | DIRGAYSGGLFDY | WGRGTLVTVSS |
| EVQLLESGGGLVQPGGSLRLSCAASGFTFS | AYWMH | WVRQAPGKGLEWVS | GISPSGGLTFYADSVKG | RFTISRDDSKNTLYLQMNSLGAEATAVYYCAR | DIRGAYSSGHFDY | WGRGTLVTVSS |
| EVQLLESGGGLVQPGGSLRLSCAASGFTFS | WYWMH | WVRQAPGKGLEWVS | GISPSGGPTMYADSVKG | RFTISRDNSKNTLYLQMNSLRAEDTAVYYCAK | DIRGPYSSGLFDY | WGRGTLVTVSS |
| EVQLLESGGGLVQPGGSLRLSCAASGFTFS | PYWMH | WVRQAPGKGLEWVS | GIGPSGGLTFYADSVKG | RFTISRDNSKNTLYLQMNSLRAEDTAVYYCAR | DMRGAYASGLFDY | WGRGTLVTVSS |

Cycle 2 Variable Light Chain Amino Acid Sequences (These are in the Same Order as the Cycle 2 Light Chain Sequences)

LV-AA (SEQ ID NOS 1026-1049)
QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

-continued
```
QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK
```

Variable Heavy Chain Amino Acid Sequences (these are in the Same Order as the Cycle 2 Light Chain Sequences)

```
HV-AA (SEQ ID NOS 1050-1074)
EVQLLESGGGLVQPGGSLRLSCAASGFTFSPYWMHWVRQAPGKGLEWVSGISSSGGDTLYA
DSVKGRFTISRDNSKNTLYLQMNGLRAEDTAVYYCARDIRGAYSSGLFFSWGRGTLVTVSS

EVQLLESGGGLVQPGGSLRLSCAASGFTFSQYFMHWVRQAPGKGLEWVSGIYPSGGDTFYA
DSVKGRFTISRDNSKNTLYLQMNSLRAEDTAVYYCARDIRGAYSSGVFDYWGRGTLVTVSS

EVQLLESGGGLVQPGGSLRLSCAASGFTFSPYWMHWVRQAPGKGLEWVSGISSSGGDTLYA
DSVKGRFTISRDNSKNTLYLQMNGLRAEDTAVYYCARDIRGAYSSGLFFSWGRGTLVTVSS

EVQLLESGGGLVQPGGSLRLSCAASGFTFSDYNMHWVRQAPGKGLEWVSYIGPSGGYTHYA
DSVKGRFTISRDNSKNTLYLQMNSLRAEDTAVYYCARDIRGAYASGLFDYWGRGTLVTVSS

EVQLLESGGGLVQPGGSLRLSCAASGFTFSWYWMHWVRQAPGKGLEWVSGIYSSGGDTIYA
DSVKGRFTISRDNSKNTLYLQMNSLRAEDTAVYYCAKDIRGPHSSGLFDYWGRGTLVTVSS

EVQLLESGGGLVQPGGSLRLSCAASGFTFSEYNMHWVRQAPGKGLEWVSGIVPSGGLTHYA
DSVKGRFTISRDNSKNTLYLQMNSLRAEDTAVYYCAKDIRGAYSSGLFDYWGRGTLVTVSS

EVQLLESGGGLVQPGGSLRLSCAASGFTFSEYNMHWVRQAPGKGLEWVSGIGPSGGPTMYA
DSVKGRFTISRDNSKNTLYLQMNSLRAEDTAVYYCAKDIRGAYSGGLFDYWGRGTLVTVSS

EVQLLESGGGLVQPGGSLRLSCAASGFTFSPYWMHWVRQAPGKGLEWVSGIGPSGGPTFYA
DSVKGRFTISRDNSKNTLYLQMNSLRAEDTAVYYCARDIMGAYASGLFHNWGRGTLVTVSS
```

-continued

```
EVQLLESGGGLVQPGGSLRLSCAASGFTFSEYNMHWVRQAPGKGLEWVSGIVPSGGLTHYA
DSVRGRFTISRDNSKNTLYLQMNSLRAEDTAVYYCAKDIRGAYSSGLFDHWGRGTLVTVSS

EVQLLESGGGLVQPGGSLRLSCAASGFTFSEYNMHWVRQAPGKGLEWVSGIVPSGGLTHYA
DSVKGRFTISRDNSKNTLYLQMNSLRAEDTAVYYCARDIAGAYSAGIFDYWGRGTLVTVSS

EVQLLESGGGLVQPGGSLRLSCAASGFTFSPYWMHWVRQAPGKGLEWVSGISPSGGETIYA
DSVKGRFTISRDNSKNTLYLQMNSLRAEDTAVYYCARDIWGAYSAGHFEYWGRGTLVTVSS

EVQLLESGGGLVQPGGSLRLSCAASGFTFSPYWMHWVRQAPGKGLEWVSSGISPSGGHTMYA
DSVKGRFTISRDNSKNTLYLQMNSLRAEDTAVYYCAKDIRGAYSSGLFDFWGRGTLVTVSS

EVQLLESGGGLVQPGGSLRLSCAASGFTFSWYMHWVRQAPGKGLEWVSGISPSGGMTMYA
DSVKGRFTISRDNSKNTLYLQMNSLRAEDTAVYYCARDIVGPYSAGLFDYWGRGTLVTVSS

EVQLLESGGGLVQPGGSLRLSCAASGFTFSWYWMHWVRQAPGKGLEWVSGISPSGYTMYA
DSVKGRFTISRDNSKNTLYLQMNSLRAEDTAVYYCAKDISGAYSSGLFTFWGRGTLVTVSS

EVQLLESGGGLVQPGGSLRLSCAASGFTFSPYWMHWVRQAPGKGLEWVSGISPSGGNTLYA
DSVKGRFTISRDNSKNTLYLQMNSLRAEDTAVYYCARDIRGAYSSGLFYDWGRGTLVTVSS

EVQLLESGGGLVQPGGSLRLSCAASGFTFSWYWMHWVRQAPGKGLEWVSGISPSGGSTFYA
DSVKGRFTISRDNSKNTLYLQMNSLRAEDTAVYYCARDFSGAYSAGLFAYWGRGTLVTVSS

EVQLLESGGGLVQPGGSLRLSCAASGFTFSYYNMHWVRQAPGKGLEWVSGIGPSGGGTLYA
DSVKGRFTISRDNSKNTLYLQMNSLRAEDTAVYYCARDLSGEYASGLFGYWGRGTLVTVSS

EVQLLESGGGLVQPGGSLRLSCAASGFTFSWYGMHWVRQAPGKGLEWVSGIVSGGETFYA
DSVKGRFTISRDNSKNTLYLQMNSLRAEDTAVYYCAKDIRGVFLSGLFDHWGRGTLVTVSS

EVQLLESGGGLVQPGGSLRLSCAASGFTFSYYNMHWVRQAPGKGLEWVSGISPSGGTTFYA
DSVKGRFTISRDNSKNTLYLQMNSLRAEDTAVYYCARDITGAYSAGLFDLWGRGTLVTVSS

EVQLLESGGGLVQPGGSLRLSCAASGFTFSPYNMHWVRQAPGKGLEWVSGISPSGGNTMYA
DSVKGRFTISRDNSKNTLYLQMNSLRAEDTAVYYCARDIWGAYASGLFDYWGRGTLVTVSS

EVQLLESGGGLVQPGGSLRLSCAASGFTFSPYWMHWVRQAPGKGLEWVSGISPSGGWTFYA
DSVKGRFTISRDNSKNTLYLQMNSLRAEDTAVYYCARDIRGAYSSGMFDFWGRGTLVTVSS

EVQLLESGGGLVQPGGSLRLSCAASGFTFSPYWMHWVRQAPGKGLEWVSGIGPSGGPTFYA
DSVKGRFTISRDNSKNTLYLQMNSLRAEDTAVYYCAKDIRGAYSGGLFDYWGRGTLVTVSS

EVQLLESGGGLVQPGGSLRLSCAASGFTFSAYWMHWVRQAPGKGLEWVSGISPSGGLTFYA
DSVKGRFTISRDDSKNTLYLQMNSLGAEATAVYYCARDIRGAYSSGHFDYWGRGTLVTVSS

EVQLLESGGGLVQPGGSLRLSCAASGFTFSWYMHWVRQAPGKGLEWVSGISPSGGPTMYA
DSVKGRFTISRDNSKNTLYLQMNSLRAEDTAVYYCAKDIRGPYSSGLFDYWGRGTLVTVSS

EVQLLESGGGLVQPGGSLRLSCAASGFTFSPYWMHWVRQAPGKGLEWVSGIPSGGLTFYA
DSVKGRFTISRDNSKNTLYLQMNSLRAEDTAVYYCARDMRGAYASGLFDYWGRGTLVTVSS
```

Light Chain Variable Region Sequences

| | | | | | | | |
|---|---|---|---|---|---|---|---|
| 539B-M0122-H05_VL + 539B-M0131-A6 VH | QDIQMTQSPSSLS ASVGDRVTITC (SEQ ID NO: 1075) | RASQNIFNYLN (SEQ ID NO: 1080) | WYQQRPGK APKLLIY (SEQ ID NO: 1085) | AASNLQT (SEQ ID NO: 1090) | GVPSRFSGSGSGTDFI FTISSLQPEDIATYYC (SEQ ID NO: 1095) | QQAGI (SEQ ID NO: 1100) | FGQGTKLEIK (SEQ ID NO: 1105) | RTVAAPS (SEQ ID NO: 1110) |
| 539B-M0131-A06-GA-D-VL | QDIQMTQSPSSL SASVGDRVTITC (SEQ ID NO: 1076) | RADQSIYTYLN (SEQ ID NO: 1081) | WYQQKPGK APKLLIY (SEQ ID NO: 1086) | AASSLQS (SEQ ID NO: 1091) | GVPSRFSGSGSGTDFT LTISSLQPEDFATYYC (SEQ ID NO: 1096) | QQAGI (SEQ ID NO: 1101) | FGQGTKLEIK (SEQ ID NO: 1106) | RTVAAPS (SEQ ID NO: 1111) |
| 539B-M0131-A06-GA-E-VL | QDIQMTQSPSSL SASVGDRVTITC (SEQ ID NO: 1077) | RAEQSIYTYLN (SEQ ID NO: 1082) | WYQQKPGK APKLLIY (SEQ ID NO: 1087) | AASSLQS (SEQ ID NO: 1092) | GVPSRFSGSGSGTDFT LTISSLQPEDFATYYC (SEQ ID NO: 1097) | QQAGI (SEQ ID NO: 1102) | FGQGTKLEIK (SEQ ID NO: 1107) | RTVAAPS (SEQ ID NO: 1112) |
| 539B-M0131-A06-GA-T-VL | QDIQMTQSPSSL SASVGDRVTITC (SEQ ID NO: 1078) | RATQSIYTYLN (SEQ ID NO: 1083) | WYQQKPGK APKLLIY (SEQ ID NO: 1088) | AASSLQS (SEQ ID NO: 1093) | GVPSRFSGSGSGTDFT LTISSLQPEDFATYYC (SEQ ID NO: 1098) | QQAGI (SEQ ID NO: 1103) | FGQGTKLEIK (SEQ ID NO: 1108) | RTVAAPS (SEQ ID NO: 1113) |
| 539B-M0131-A06-GA-V-VL | QDIQMTQSPSSL SASVGDRVTITC (SEQ ID NO: 1079) | RAVQSIYTYLN (SEQ ID NO: 1084) | WYQQKPGK APKLLIY (SEQ ID NO: 1089) | AASSLQS (SEQ ID NO: 1094) | GVPSRFSGSGSGTDFT LTISSLQPEDFATYYC (SEQ ID NO: 1099) | QQAGI (SEQ ID NO: 1104) | FGQGTKLEIK (SEQ ID NO: 1109) | RTVAAPS (SEQ ID NO: 1114) |

Heavy Chain Sequences (in the Same Order as Above)

EVQLLESGGGLVQPG
GSLRLSCAASGFTFS
(SEQ ID NO:
1115)

WYWMH
(SEQ ID
NO:
1120)

WVRQAPG
KGLEWVS
(SEQ ID
NO: 1125)

GISPSGGMT
MYADSVKG
(SEQ ID
NO: 1130)

RFTISRDNSKNTLYLQ
MNSLRAEDTAVYYCAR
(SEQ ID NO:
1135)

DIVGPYS
AGLFDY
(SEQ ID
NO: 1140)

WGRGTL
VTVSS
(SEQ ID
NO: 1145)

EVQLLESGGGLVQPG
GSLRLSCAASGFTFS
(SEQ ID NO:
1116)

WYWMH
(SEQ ID
NO:
1121)

WVRQAPG
KGLEWVS
(SEQ ID
NO: 1126)

GISPSGGMT
MYADSVKG
(SEQ ID
NO: 1131)

RFTISRDNSKNTLYLQ
MNSLRAEDTAVYYCAR
(SEQ ID NO:
1136)

DIVGPYS
AGLFDY
(SEQ ID
NO: 1141)

WGRGTL
VTVSS
(SEQ ID
NO: 1146)

EVQLLESGGGLVQPG
GSLRLSCAASGFTFS
(SEQ ID NO:
1117)

WYWMH
(SEQ ID
NO:
1122)

WVRQAPG
KGLEWVS
(SEQ ID
NO: 1127)

GISPSGGMT
MYADSVKG
(SEQ ID
NO: 1132)

RFTISRDNSKNTLYLQ
MNSLRAEDTAVYYCAR
(SEQ ID NO:
1137)

DIVGPYS
AGLFDY
(SEQ ID
NO: 1142)

WGRGTL
VTVSS
(SEQ ID
NO: 1147)

EVQLLESGGGLVQPG
GSLRLSCAASGFTFS
(SEQ ID NO:
1118)

WYWMH
(SEQ ID
NO:
1123)

WVRQAPG
KGLEWVS
(SEQ ID
NO: 1128)

GISPSGGMT
MYADSVKG
(SEQ ID
NO: 1133)

RFTISRDNSKNTLYLQ
MNSLRAEDTAVYYCAR
(SEQ ID NO:
1138)

DIVGPYS
AGLFDY
(SEQ ID
NO: 1143)

WGRGTL
VTVSS
(SEQ ID
NO: 1148)

EVQLLESGGGLVQPG
GSLRLSCAASGFTFS
(SEQ ID NO:
1119)

WYWMH
(SEQ ID
NO:
1124)

WVRQAPG
KGLEWVS
(SEQ ID
NO: 1129)

GISPSGGMT
MYADSVKG
(SEQ ID
NO: 1134)

RFTISRDNSKNTLYLQ
MNSLRAEDTAVYYCAR
(SEQ ID NO:
1139)

DIVGPYS
AGLFDY
(SEQ ID
NO: 1144)

WGRGTL
VTVSS
(SEQ ID
NO: 1149)

Cycle 3 Inhibitors-Light Chains

| Initial Name | LV-FR1 (SEQ ID NOS 1150-1194) | LV-CDR1 (SEQ ID NOS 1195-1239) | LV-FR2 (SEQ ID NOS 1240-1284) | LV-CDR2 (SEQ ID NOS 1285-1329) | LV-FR3 (SEQ ID NOS 1330-1375) | LV-CDR3 (SEQ ID NOS 1375-1419) | LV-FR4 (SEQ ID NOS 1420-1464) | L-Constant (SEQ ID NOS 1465-1509) |
|---|---|---|---|---|---|---|---|---|
| 539B-M0134-A02 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-A05 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-A07 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-A09 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-A10 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-A11 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-B01 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-B04 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-B08 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-B11 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-C01 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-C02 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-C06 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-C09 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |

-continued

| Initial Name | LV-FR1 (SEQ ID NOS 1150-1194) | LV-CDR1 (SEQ ID NOS 1195-1239) | LV-FR2 (SEQ ID NOS 1240-1284) | LV-CDR2 (SEQ ID NOS 1285-1329) | LV-FR3 (SEQ ID NOS 1330-1375) | LV-CDR3 (SEQ ID NOS 1375-1419) | LV-FR4 (SEQ ID NOS 1420-1464) | L-Constant (SEQ ID NOS 1465-1509) |
|---|---|---|---|---|---|---|---|---|
| 539B-M0134-C10 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-C11 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-C12 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-D02 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-D03 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-E04 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-E07 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-E08 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-E11 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-F01 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-F05 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-G02 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-G04 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0134-G07 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-A03 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-A05 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-A06 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-A07 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-B02 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-B08 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-C01 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-C11 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-E03 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-F03 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |

| Initial Name | LV-FR1 (SEQ ID NOS 1150-1194) | LV-CDR1 (SEQ ID NOS 1195-1239) | LV-FR2 (SEQ ID NOS 1240-1284) | LV-CDR2 (SEQ ID NOS 1285-1329) | LV-FR3 (SEQ ID NOS 1330-1375) | LV-CDR3 (SEQ ID NOS 1375-1419) | LV-FR4 (SEQ ID NOS 1420-1464) | L-Constant (SEQ ID NOS 1465-1509) |
|---|---|---|---|---|---|---|---|---|
| 539B-M0135-F11 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-G02 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-G03 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-G07 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-G11 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-H03 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |
| 539B-M0135-H10 | QDIQMTQSPSSL SASVGDRVTITC | RANQSI YTYLN | WYQQKPGK APELLIY | AASSLQS | GVPSRFSGSGSGTDFT LTISSLQPEDFATYYC | QQAGI | FGQGTKLEIK | RTVAAPS |

Cycle 3 Heavy Chain Variable Regions (in the Same Order as the Light Chains Provided Above)

| HV-FR1 (SEQ ID NOS 1510-1554) | HV-CDR1 (SEQ ID NOS 1555-1599) | HV-FR2 (SEQ ID NOS 1600-1644) | HV-CDR2 (SEQ ID NOS 1645-1689) | HV-FR3 (SEQ ID NOS 1690-1734) | HV-CDR3 (SEQ ID NOS 1735-1779) |
|---|---|---|---|---|---|
| EVQLLESGGGLVQPG GSLRLSCAASGFTFS | PYWMH | WVRQAPGKGLEWVS | GISPSGGETIYADSVKG | RFTISRDNSKNTLYLQ MNSLRAEDTAVYYCAR | DIWGAYASGLFDY |
| EVQLLESGGGLVQPG GSLRLSCAASGFTFS | WYWMV | WVRQAPGKGLEWVS | SIGPSGGDTYYADSVKG | RFTISRDNSKNTLYLQ MNSLRAEDTAVYYCAR | DIRGAYSSGLFYD |
| EVQLLESGGGLVQPG GSLRLSCAASGFTFS | EYWMA | WVRQAPGKGLEWVS | SISPSGGHTFYADSVKG | RFTISRDNSKNTLYLQ MNSLRAEDTAVYYCAR | DMRGAYASGLFDY |
| EVQLLESGGGLVQPG GSLRLSCAASGFTFS | PYWMH | WVRQAPGKGLEWVS | GIGPSGGPTFYADSIKG | RFTISRDNSKNTLYLQ MNSLRAEDTAVYYCAR | DIWGAYASGLFDY |
| EVQLLESGGGLVQPG GSLRLSCAASGFTFS | PYWMH | WVRQAPGKGLEWVS | GIGPSGGPTFYADSIKG | RFTISRDNSKNTLYLQ MNSLRAEDTAVYYCAK | DIRGPYSSGLFDY |
| EVQLLESGGGLVQPG GSLRLSCAASGFTFS | WYWMH | WVRQAPGKGLEWVS | GIVSSGGTTIYADSVKG | RFTISRDDSKNTLYLQ MNSLGAEATAVYYCAR | DIRGAYSSGHFDY |
| EVQLLESGGGLVQPG GSLRLSCAASGFTFS | PYWMH | WVRQAPGKGLEWVS | GISPSGGNTLYADSVKG | RFTISRDNSKNTLYLQ MNSLRAEDTAVYYCAK | DISGAYSSGLFTF |
| EVQLLESGGGLVQPG GSLRLSCAASGFTFS | WYWMV | WVRQAPGKGLEWVS | SIVPSGGFTIYADSVKG | RFTISRDNSKNTLYLQ MNSLRAEDTAVYYCAK | DIRGAYSSGLFDY |
| EVQLLESGGGLVQPG GSLRLSCAASGFTFS | WYWMH | WVRQAPGKGLEWVS | GISPSGGPTMYADSVKG | RFTISRDNSKNTLYLQ MNSLRAEDTAVYYCAK | DIRGPYSSGLFDY |
| EVQLLESGGGLVQPG GSLRLSCAASGFTFS | PYWMH | WVRQAPGKGLEWVS | GIGPSGGLTFYADSVKG | RFTISRDNSKNTLYLQ MNSLRAEDTAVYYCAR | DIRGAYSSGMFDF |
| EVQLLESGGGLVQPG GSLRLSCAASGFTFS | HYWMQ | WVRQAPGKGLEWVS | GIVPSGGLTMYADSVKG | RFTISRDNSKNTLYLQ MNSLRAEDTAVYYCAK | DISGAYSSGLFTF |
| EVQLLESGGGLVQPG GSLRLSCAASGFTFS | WYWMG | WVRQAPGKGLEWVS | SISPSGGYTFYADSVKG | RFTISRDNSKNTLYLQ MNSLRAEDTAVYYCAR | DMRGAYASGLFDY |
| EVQLLESGGGLVQPG GSLRLSCAASGFTFS | PYWMH | WVRQAPGKGLEWVS | GIGPSGGLTFYADSVKG | RFTISRDNSKNTLYLQ MNSLRAEDTAVYYCAK | DIRGAYSSGLFDF |

-continued

| HV-FR1 (SEQ ID NOS 1510-1554) | HV-CDR1 (SEQ ID NOS 1555-1599) | HV-FR2 (SEQ ID NOS 1600-1644) | HV-CDR2 (SEQ ID NOS 1645-1689) | HV-FR3 (SEQ ID NOS 1690-1734) | HV-CDR3 (SEQ ID NOS 1735-1779) |
|---|---|---|---|---|---|
| EVQLLESGGGLVQPG GSLRLSCAASGFTFS | EYWMT | WVRQAPGKGLEWVS | GISPSGGMTFYADSVKG | RFTISRDNSKNTLYLQ MNSLRAEDTAVYYCAR | DMRGAYASGLFDY |
| EVQLLESGGGLVQPG GSLRLSCAASGFTFS | WYWMH | WVRQAPGKGLEWVS | GIVSSGGTTIYADSVKG | RFTISRDNSKNTLYLQ MNSLRAEDTAVYYCAK | DIRGPYSSGLFDY |
| EVQLLESGGGLVQPG GSLRLSCAASGFTFS | PYNMH | WVRQAPGKGLEWVS | GISPSGGNTMYADSVKG | RFTISRDDSKNTLYLQ MNSLGAEATAVYYCAR | DIRGAYSSGHFDY |
| EVQLLESGGGLVQPG GSLRLSCAASGFTFS | WYWMG | WVRQAPGKGLEWVS | SISPSGGYTFYADSVKG | RFTISRDNSKNTLYLQ MNSLRAEDTAVYYCAK | DIRGAYSSGLFDY |
| EVQLLESGGGLVQPG GSLRLSCAASGFTFS | EYWMT | WVRQAPGKGLEWVS | GISPSGGMTFYADSVKG | RFTISRDNSKNTLYLQ MNSLRAEDTAVYYCAK | DIRGAYSSGLFDY |
| EVQLLESGGGLVQPG GSLRLSCAASGFTFS | WYWMV | WVRQAPGKGLEWVS | SIVPSGGFTIYADSVKG | RFTISRDNSKNTLYLQ MNSLRAEDTAVYYCAR | DLSGEYASGLFGY |
| EVQLLESGGGLVQPG GSLRLSCAASGFTFS | WYNMS | WVRQAPGKGLEWVS | RISPSGGDTGYADSVKG | RFTISRDNSKNTLYLQ MNSLRAEDTAVYYCAK | DIRGAYSGGLFDY |
| EVQLLESGGGLVQPG GSLRLSCAASGFTFS | EYWMT | WVRQAPGKGLEWVS | GISPSGGMTFYADSVKG | RFTISRDNSKNTLYLQ MNSLRAEDTAVYYCAR | DIRGAYSSGMFDF |
| EVQLLESGGGLVQPG GSLRLSCAASGFTFS | WYWMV | WVRQAPGKGLEWVS | SIGPSGGDTYYADSVKG | RFTISRDNSKNTLYLQ MNSLRAEDTAVYYCAR | DLSGEYASGLFGY |
| EVQLLESGGGLVQPG GSLRLSCAASGFTFS | WYWMV | WVRQAPGKGLEWVS | SIVPSGGFTIYADSVKG | RFTISRDNSKNTLYLQ MNSLRAEDTAVYYCAK | DISGAYSSGLFTF |
| EVQLLESGGGLVQPG GSLRLSCAASGFTFS | WYWMH | WVRQAPGKGLEWVS | GIVSSGGTTIYADSVKG | RFTISRDNSKNTLYLQ MNSLRAEDTAVYYCAK | DIRGAYSSGLFDH |
| EVQLLESGGGLVQPG GSLRLSCAASGFTFS | AYWMH | WVRQAPGKGLEWVS | GISPSGGLTFYADSVKG | RFTISRDNSKNTLYLQ MNSLRAEDTAVYYCAR | DIWGAYASGLFDY |
| EVQLLESGGGLVQPG GSLRLSCAASGFTFS | WYWMV | WVRQAPGKGLEWVS | SIGPSGGDTYYADSVKG | RFTISRDNSKNTLYLQ MNSLRAEDTAVYYCAR | DIWGAYSAGHFEY |
| EVQLLESGGGLVQPG GSLRLSCAASGFTFS | WYWMH | WVRQAPGKGLEWVS | GIVSSGGTTIYADSVKG | RFTISRDNSKNTLYLQ MNSLRAEDTAVYYCAR | DIWGAYSAGHFEY |
| EVQLLESGGGLVQPG GSLRLSCAASGFTFS | WYWMH | WVRQAPGKGLEWVS | GIVSSGGTTIYADSVKG | RFTISRDNSKNTLYLQ MNSLRAEDTAVYYCAR | DIRGAYSSGLFYD |
| EVQLLESGGGLVQPG GSLRLSCAASGFTFS | PYWMS | WVRQAPGKGLEWVS | GISPSGGITFYADSVKG | RFTISRDNSKNTLYLQ MNSLRAEDTAVYYCAR | DLSGEYASGLFGY |
| EVQLLESGGGLVQPG GSLRLSCAASGFTFS | YYGMG | WVRQAPGKGLEWVS | VISSSGGFTFYADSVKG | RFTISRDNSKNTLYLQ MNSLRAEDTAVYYCAK | DISGAYSSGLFTF |
| EVQLLESGGGLVQPG GSLRLSCAASGFTFS | WYWMH | WVRQAPGKGLEWVS | GIVSSGGTTIYADSVKG | RFTISRDNSKNTLYLQ MNSLRAEDTAVYYCAR | DIRGAYSSGLFDF |
| EVQLLESGGGLVQPG GSLRLSCAASGFTFS | WYWMG | WVRQAPGKGLEWVS | SISPSGGYTFYADSVKG | RFTISRDNSKNTLYLQ MNSLRAEDTAVYYCAR | DLSGEYASGLFGY |
| EVQLLESGGGLVQPG GSLRLSCAASGFTFS | PYWMH | WVRQAPGKGLEWVS | GISPSGGNTLYADSVKG | RFTISRDNSKNTLYLQ MNSLRAEDTAVYYCAK | DIRGAYSSGLFDY |
| EVQLLESGGGLVQPG GSLRLSCAASGFTFS | WYWMH | WVRQAPGKGLEWVS | GIVSSGGTTIYADSVKG | RFTISRDNSKNTLYLQ MNSLRAEDTAVYYCAR | DFSGAYSAGLFAY |
| EVQLLESGGGLVQPG GSLRLSCAASGFTFS | PYWMH | WVRQAPGKGLEWVS | GIGPSGGPTFYADSVKG | RFTISRDNSKNTLYLQ MNSLRAEDTAVYYCAK | DIRGAYSSGLFDY |
| EVQLLESGGGLVQPG GSLRLSCAASGFTFS | EYWMA | WVRQAPGKGLEWVS | SISPSGGHTFYADSVKG | RFTISRDNSKNTLYLQ MNSLRAEDTAVYYCAK | DIRGPYSSGLFDY |
| EVQLLESGGGLVQPG GSLRLSCAASGFTFS | WYWMV | WVRQAPGKGLEWVS | SIGPSGGDTYYADSVKG | RFTISRDNSKNTLYLQ MNSLRAEDTAVYYCAK | DIRGAYSSGLFDY |
| EVQLLESGGGLVQPG GSLRLSCAASGFTFS | PYWMH | WVRQAPGKGLEWVS | GIGPSGGLTFYADSVKG | RFTISRDNSKNTLYLQ MNSLRAEDTAVYYCAK | DIRGAYSSGLFDH |

| HV-FR1 (SEQ ID NOS 1510-1554) | HV-CDR1 (SEQ ID NOS 1555-1599) | HV-FR2 (SEQ ID NOS 1600-1644) | HV-CDR2 (SEQ ID NOS 1645-1689) | HV-FR3 (SEQ ID NOS 1690-1734) | HV-CDR3 (SEQ ID NOS 1735-1779) |
| --- | --- | --- | --- | --- | --- |
| EVQLLESGGGLVQPG GSLRLSCAASGFTFS | HYWMQ | WVRQAPGKGLEWVS | GIVPSGGLTMYADSVKG | RFTISRDNSKNTLYLQ MNSLRAEDTAVYYCAR | DIMGAYASGLFHN |
| EVQLLESGGGLVQPG GSLRLSCAASGFTFS | EYWMT | WVRQAPGKGLEWVS | GISPSGGMTFYADSVKG | RFTISRDNSKNTLYLQ MNSLRAEDTAVYYCAK | DIRGAYSSGLFDF |
| EVQLLESGGGLVQPG GSLRLSCAASGFTFS | PYWMS | WVRQAPGKGLEWVS | GISPSGGITFYADSVKG | RFTISRDNSKNTLYLQ MNSLRAEDTAVYYCAR | DIWGAYSAGHFEY |
| EVQLLESGGGLVQPG GSLRLSCAASGFTFS | WYWMH | WVRQAPGKGLEWVS | GIVSSGGTTIYADSVKG | RFTISRDNSKNTLYLQ MNSLRAEDTAVYYCAR | DLSGEYASGLFGY |
| EVQLLESGGGLVQPG GSLRLSCAASGFTFS | WYWMV | WVRQAPGKGLEWVS | SIGPSGGDTYYADSVKG | RFTISRDNSKNTLYLQ MNSLRAEDTAVYYCAR | DMRGAYASGLFDY |
| EVQLLESGGGLVQPG GSLRLSCAASGFTFS | WYNMS | WVRQAPGKGLEWVS | RISPSGGDTGYADSVKG | RFTISRDNSKNTLYLQ MNSLRAEDTAVYYCAK | DIRGAYSSGLFDH |
| EVQLLESGGGLVQPG GSLRLSCAASGFTFS | PYWMH | WVRQAPGKGLEWVS | GIGPSGGPTFYADSIKG | RFTISRDNSKNTLYLQ MNSLRAEDTAVYYCAK | DIRGAYSGGLFDY |

Cycle 3 Light Chain Amino Acid Sequences (Provided in the Same Order as the Cycle 3 Light Chains Provided Above)

```
LV-AA (SEQ ID NOS 1780-1824)
QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
```

-continued

SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

```
QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK

QDIQMTQSPSSLSASVGDRVTITCRANQSIYTYLNWYQQKPGKAPELLIYAASSLQSGVPSRF
SGSGSGTDFTLTISSLQPEDFATYYCQQAGIFGQGTKLEIK
```

Cycle 3 Heavy Chain Amino Acid Sequences (Provided in the Same Order as the Cycle 3 Light Chains Provided Above)

```
HV-AA (SEQ ID NOS 1825-1869)
EVQLLESGGGLVQPGGSLRLSCAASGFTFSPYWMHWVRQAPGKGLEWVSG

ISPSGGETIYADSVKGRFTISRDNSKNTLYLQMNSLRAEDTAVYYCARDI

WGAYASGLFDYWGRGTLVTVSS

EVQLLESGGGLVQPGGSLRLSCAASGFTFSWYWMVWVRQAPGKGLEWVSS

IGPSGGDTYYADSVKGRFTISRDNSKNTLYLQMNSLRAEDTAVYYCARDI

RGAYSSGLFYDWGRGTLVTVSS

EVQLLESGGGLVQPGGSLRLSCAASGFTFSEYWMAWVRQAPGKGLEWVSS

ISPSGGHTFYADSVKGRFTISRDNSKNTLYLQMNSLRAEDTAVYYCARDM

RGAYASGLFDYWGRGTLVTVSS

EVQLLESGGGLVQPGGSLRLSCAASGFTFSPYWMHWVRQAPGKGLEWVSG

IGPSGGPTFYADSIKGRFTISRDNSKNTLYLQMNSLRAEDTAVYYCARDI

WGAYASGLFDYWGRGTLVTVSS

EVQLLESGGGLVQPGGSLRLSCAASGFTFSPYWMHWVRQAPGKGLEWVSG

IGPSGGPTFYADSIKGRFTISRDNSKNTLYLQMNSLRAEDTAVYYCAKDI

RGPYSSGLFDYWGRGTLVTVSS

EVQLLESGGGLVQPGGSLRLSCAASGFTFSWYWMHWVRQAPGKGLEWVSG

IVSSGGTTIYADSVKGRFTISRDDSKNTLYLQMNSLGAEATAVYYCARDI

RGAYSSGHFDYWGRGTLVTVSS

EVQLLESGGGLVQPGGSLRLSCAASGFTFSPYWMHWVRQAPGKGLEWVSG

ISPSGGNTLYADSVKGRFTISRDNSKNTLYLQMNSLRAEDTAVYYCAKDI

SGAYSSGLFTFWGRGTLVTVSS

EVQLLESGGGLVQPGGSLRLSCAASGFTFSWYWMVWVRQAPGKGLEWVSS

IVPSGGFTIYADSVKGRFTISRDNSKNTLYLQMNSLRAEDTAVYYCAKDI

RGAYSSGLFDYWGRGTLVTVSS

EVQLLESGGGLVQPGGSLRLSCAASGFTFSWYWMHWVRQAPGKGLEWVSG

ISPSGGPTMYADSVKGRFTISRDNSKNTLYLQMNSLRAEDTAVYYCAKDI

RGPYSSGLFDYWGRGTLVTVSS

EVQLLESGGGLVQPGGSLRLSCAASGFTFSPYWMHWVRQAPGKGLEWVSG

IGPSGGLTFYADSVKGRFTISRDNSKNTLYLQMNSLRAEDTAVYYCARDI

RGAYSSGMFDFWGRGTLVTVSS

EVQLLESGGGLVQPGGSLRLSCAASGFTFSHYWMQWVRQAPGKGLEWVSG

IVPSGGLTMYADSVKGRFTISRDNSKNTLYLQMNSLRAEDTAVYYCAKDI

SGAYSSGLFTFWGRGTLVTVSS

EVQLLESGGGLVQPGGSLRLSCAASGFTFSWYWMGWVRQAPGKGLEWVSS

ISPSGGYTFYADSVKGRFTISRDNSKNTLYLQMNSLRAEDTAVYYCARDM

RGAYASGLFDYWGRGTLVTVSS

EVQLLESGGGLVQPGGSLRLSCAASGFTFSPYWMHWVRQAPGKGLEWVSG

IGPSGGLTFYADSVKGRFTISRDNSKNTLYLQMNSLRAEDTAVYYCAKDI

RGAYSSGLFDFWGRGTLVTVSS

EVQLLESGGGLVQPGGSLRLSCAASGFTFSEYWMTWVRQAPGKGLEWVSG

ISPSGGMTFYADSVKGRFTISRDNSKNTLYLQMNSLRAEDTAVYYCARDM

RGAYASGLFDYWGRGTLVTVSS

EVQLLESGGGLVQPGGSLRLSCAASGFTFSWYWMHWVRQAPGKGLEWVSG

IVSSGGTTIYADSVKGRFTISRDNSKNTLYLQMNSLRAEDTAVYYCAKDI

RGPYSSGLFDYWGRGTLVTVSS

EVQLLESGGGLVQPGGSLRLSCAASGFTFSPYNMHWVRQAPGKGLEWVSG

ISPSGGNTMYADSVKGRFTISRDDSKNTLYLQMNSLGAEATAVYYCARDI

RGAYSSGHFDYWGRGTLVTSL

EVQLLESGGGLVQPGGSLRLSCAASGFTFSWYWMGWVRQAPGKGLEWVSS

ISPSGGYTFYADSVKGRFTISRDNSKNTLYLQMNSLRAEDTAVYYCAKDI

RGAYSSGLFDYWGRGTLVTVSS

EVQLLESGGGLVQPGGSLRLSCAASGFTFSEYWMTWVRQAPGKGLEWVSG

ISPSGGMTFYADSVKGRFTISRDNSKNTLYLQMNSLRAEDTAVYYCAKDI

RGAYSSGLFDYWGRGTLVTVSS

EVQLLESGGGLVQPGGSLRLSCAASGFTFSWYWMVWVRQAPGKGLEWVSS

IVPSGGFTIYADSVKGRFTISRDNSKNTLYLQMNSLRAEDTAVYYCARDL

SGEYASGLFGYWGRGTLVTVSS

EVQLLESGGGLVQPGGSLRLSCAASGFTFSWYNMSWVRQAPGKGLEWVSR

ISPSGGDTGYADSVKGRFTISRDNSKNTLYLQMNSLRAEDTAVYYCAKDI

RGAYSSGLFDYWGRGTLVTVSS

EVQLLESGGGLVQPGGSLRLSCAASGFTFSEYWMTWVRQAPGKGLEWVSG

ISPSGGMTFYADSVKGRFTISRDNSKNTLYLQMNSLRAEDTAVYYCARDI

RGAYSSGMFDFWGRGTLVTVSS

EVQLLESGGGLVQPGGSLRLSCAASGFTFSWYWMVWVRQAPGKGLEWVSS

IGPSGGDTYYADSVKGRFTISRDNSKNTLYLQMNSLRAEDTAVYYCARDL

SGEYASGLFGYWGRGTLVTVSS
```

-continued

EVQLLESGGGLVQPGGSLRLSCAASGFTFSWYWMVWVRQAPGKGLEWVSS
IVPSGGFTIYADSVKGRFTISRDNSKNTLYLQMNSLRAEDTAVYYCAKDI
SGAYSSGLFTFWGRGTLVTVSS

EVQLLESGGGLVQPGGSLRLSCAASGFTFSWYWMHWVRQAPGKGLEWVSG
IVSSGGTTIYADSVKGRFTISRDNSKNTLYLQMNSLRAEDTAVYYCAKDI
RGAYSSGLFDHWGRGTLVTVSS

EVQLLESGGGLVQPGGSLRLSCAASGFTFSAYWMHWVRQAPGKGLEWVSG
ISPGGLTFYADSVKGRFTISRDNSKNTLYLQMNSLRAEDTAVYYCARDI
WGAYASGLFDYWGRGTLVTVSS

EVQLLESGGGLVQPGGSLRLSCAASGFTFSWYWMVWVRQAPGKGLEWVSS
IGPSGGDTYYADSVKGRFTISRDNSKNTLYLQMNSLRAEDTAVYYCARDI
WGAYSAGHFEYWGRGTLVTVSS

EVQLLESGGGLVQPGGSLRLSCAASGFTFSWYWMHWVRQAPGKGLEWVSG
IVSSGGTTIYADSVKGRFTISRDNSKNTLYLQMNSLRAEDTAVYYCARDI
WGAYSAGHFEYWGRGTLVTVSS

EVQLLESGGGLVQPGGSLRLSCAASGFTFSWYWMHWVRQAPGKGLEWVSG
IVSSGGTTIYADSVKGRFTISRDNSKNTLYLQMNSLRAEDTAVYYCARDI
RGAYSSGLFYDWGRGTLVTVSS

EVQLLESGGGLVQPGGSLRLSCAASGFTFSPYWMSWVRQAPGKGLEWVSG
ISPSGGITFYADSVKGRFTISRDNSKNTLYLQMNSLRAEDTAVYYCARDL
SGEYASGLFGYWGRGTLVTVSS

EVQLLESGGGLVQPGGSLRLSCAASGFTFSYYGMGWVRQAPGKGLEWVSV
ISSSGGFTFYADSVKGRFTISRDNSKNTLYLQMNSLRAEDTAVYYCAKDI
SGAYSSGLFTFWGRGTLVTVSS

EVQLLESGGGLVQPGGSLRLSCAASGFTFSWYWMHWVRQAPGKGLEWVSG
IVSSGGTTIYADSVKGRFTISRDNSKNTLYLQMNSLRAEDTAVYYCAKDI
RGAYSSGLFDFWGRGTLVTVSS

EVQLLESGGGLVQPGGSLRLSCAASGFTFSWYWMGWVRQAPGKGLEWVSS
ISPSGGYTFYADSVKGRFTISRDNSKNTLYLQMNSLRAEDTAVYYCARDL
SGEYASGLFGYWGRGTLVTVSS

EVQLLESGGGLVQPGGSLRLSCAASGFTFSPYWMHWVRQAPGKGLEWVSG
ISPSGGNTLYADSVKGRFTISRDNSKNTLYLQMNSLRAEDTAVYYCAKDI
RGAYSSGLFDYWGRGTLVTVSS

EVQLLESGGGLVQPGGSLRLSCAASGFTFSWYWMHWVRQAPGKGLEWVSG
IVSSGGTTIYADSVKGRFTISRDNSKNTLYLQMNSLRAEDTAVYYCARDF
SGAYSAGLFAYWGRGTLVTVSS

EVQLLESGGGLVQPGGSLRLSCAASGFTFSPYWMHWVRQAPGKGLEWVSG
ISPSGGPTFYADSVKGRFTISRDNSKNTLYLQMNSLRAEDTAVYYCAKDI
RGAYSSGLFDYWGRGTLVTVSS

EVQLLESGGGLVQPGGSLRLSCAASGFTFSEYWMAWVRQAPGKGLEWVSS
ISPSGGHTFYADSVKGRFTISRDNSKNTLYLQMNSLRAEDTAVYYCAKDI
RGPYSSGLFDYWGRGTLVTVSS

EVQLLESGGGLVQPGGSLRLSCAASGFTFSWYWMVWVRQAPGKGLEWVSS
IGPSGGDTYYADSVKGRFTISRDNSKNTLYLQMNSLRAEDTAVYYCAKDI
RGAYSSGLFDYWGRGTLVTVSS

EVQLLESGGGLVQPGGSLRLSCAASGFTFSPYWMHWVRQAPGKGLEWVSG
IGPSGGLTFYADSVKGRFTISRDNSKNTLYLQMNSLRAEDTAVYYCAKDI
RGAYSSGLFDHWGRGTLVTVSS

EVQLLESGGGLVQPGGSLRLSCAASGFTFSHYWMQWVRQAPGKGLEWVSG
IVPSGGLTMYADSVKGRFTISRDNSKNTLYLQMNSLRAEDTAVYYCARDI
MGAYASGLFHNWGRGTLVTVSS

EVQLLESGGGLVQPGGSLRLSCAASGFTFSEYWMTWVRQAPGKGLEWVSG
ISPGGMTFYADSVKGRFTISRDNSKNTLYLQMNSLRAEDTAVYYCAKDI
RGAYSSGLFDFWGRGTLVTVSS

EVQLLESGGGLVQPGGSLRLSCAASGFTFSPYWMSWVRQAPGKGLEWVSG
ISPSGGITFYADSVKGRFTISRDNSKNTLYLQMNSLRAEDTAVYYCARDI
WGAYSAGHFEYWGRGTLVTVSS

EVQLLESGGGLVQPGGSLRLSCAASGFTFSWYWMHWVRQAPGKGLEWVSG
IVSSGGTTIYADSVKGRFTISRDNSKNTLYLQMNSLRAEDTAVYYCARDL
SGEYASGLFGYWGRGTLVTVSS

EVQLLESGGGLVQPGGSLRLSCAASGFTFSWYWMVWVRQAPGKGLEWVSS
IGPSGGDTYYADSVKGRFTISRDNSKNTLYLQMNSLRAEDTAVYYCARDM
RGAYASGLFDYWGRGTLVTVSS

EVQLLESGGGLVQPGGSLRLSCAASGFTFSWYNMSWVRQAPGKGLEWVSR
ISPSGGDTGYADSVKGRFTISRDNSKNTLYLQMNSLRAEDTAVYYCAKDI
RGAYSSGLFDHWGRGTLVTVSS

EVQLLESGGGLVQPGGSLRLSCAASGFTFSPYWMHWVRQAPGKGLEWVSG
IGPSGGPTFYADSIKGRFTISRDNSKNTLYLQMNSLRAEDTAVYYCAKDI
RGAYSGGLFDYWGRGTLVTVSS

| Initial Name: | L-Variable (AA) (SEQ ID NOS 1870-1938): |
|---|---|
| 539A-M0013-A02 | QDIQMTQSPGTLSLSPGERATLSCRASQSVSSYLAW YQQKPGQAPRLLIYDASNRATGIOARFSGSGSGTDF TLTISSLEPEDFAVYYCQQRSNWPITFGQGTRLEIK |
| 539A-M0013-A03 | QDIQMTQSPSSVSASVGDRVTITCRASQSISSWLAW YQQKPGKAPKLLISTASNLQSGVPSRFSGSGSGTDF TLTISSLQPEDFATYYCQQVSNFPITFGQGTRLEIK |
| 539A-M0013-A11 | QDIQMTQSPATLSLSPGERATLSCRASQSVSSYLAW YQQKPGQAPRLLIYDASNRATGIPARFSGSGSGTDF TLTISSLEPEDFAVYYCQHNEGWPWTFGQGTKVEVK |
| 539A-M0013-B07 | QDIQMTQSPSSLSASVGDRVTITCQASQDISNYLNW YQQKPGKAPKLLIYAASKLEDGVPSRFSGSGTGTDF TLTIRSLQPEDFASYFCQQSYSSPGITFGPGTKVEI K |

| Initial Name: | L-Variable (AA) (SEQ ID NOS 1870-1938): |
|---|---|
| 539A-M0013-B08 | QDIMTQSPSSFSASTGDRVTITCRASQGISSYLAWY QQKPGKAPKLLIYAASTLQSGVPSRFSGSGSGTHYT LTINSLQPEDFATYYCQQANSFPLTFGGGTKVEIK |
| 539A-M0013-B10 | QSVLTQPPSASGTPGQRVTISCSGSSSNIGSNTVNW YQQLPGTAPKLLIYSNNQRPSGVPDRFSGSKSGTSA PLAISGLQFEDEADYYCAVWDDSLNGWVFGGGTKLT VL |
| 539A-M0013-D02 | QDIQMTQSPGTLSLSPGERAALSCRASQSVSSNYLA WYQQKPGQAPRLLMYGASNRATGIPDRFSGSGSGTD FTLTISRLEPEDFAVYYCQQYGRSPRTFGQGTKLEI K |
| 539A-M0013-D04 | QDIQMTQSPGILSLSPGDRATLSCRASQSVTSSSLA WYQQRPGQSPRLLIYGASSRATGIPDRFSGSGSGTD FTLIISRLEPEDFASYYCQQYGGSPITFGPGTKVDI K |
| 539A-M0013-D06 | QDIQMTQSPSSVSASVGDRVTITCRASQDVGSWLAW YQQKPGKAPKLLIFAASSLESGIPSRFSGSGSGTDF TLTISSLQPEDFATYYCQQANGFPLTFGGGTKVEIK |
| 539A-M0013-D10 | QDIQMTQSPGTLSLSPGERATLSCRASQSVSSSYLA WYQQKPGQAPRLLIYGASSRATGIPDRFSGSGSGTD FTLTISRLEPEDFAVYYCQQYGSSPPITFGQGTRLE IK |
| 539A-M0013-E05 | QDIQMTQSPATLSLSPGERATLSCRASQSVDHFLAW YQQKPGQAPRLLIYGATNRATGVPARFNGTGSGTDF TLTISSLEPEDFAVYYCQQRLNWPPWTFGQGTKVEI K |
| 539A-M0013-F07 | QDIQMTQSPSSLSASVGDRVTITCRANQSIYTYLNW YQQKPGKAPELLIYAASSLQSGVPSRFSGSGSGTDF TLTISSLQPEDFATYYCQQAGIFGQGTKLEIK |
| 539A-M0013-G04 | QYELTQPPSASGTPGQTVTISCSGSTSNIGSNTVAW YQQVPGTAPKLLIHTNNQRPSGVSDRFSGSKSVASA SLAINGLQSEDEADYYCAGWDDSLNGAVFGGGTKVT VL |
| 539A-M0013-H04 | QDIQMTQSPSFLSASVGDRVTITCRASQGISSYLAW YQQKPGKAPKLLIYGASTLQSGVPSRFSGSGSGTDF TLTISSLQPEDFATYYCQQSYTPYTFGQGTKLEIK |
| 539A-M0014-A09 | QDIQMTQSPGTLSLSPGERATLSCRASQSVSGSYLA WYQQKPGQAPRLLIYGASSRATGIPDRFSGSGSGTD FTLTITRLEPEDFAVYYCQQYGSSPRTFGQGTKVEI K |
| 539A-M0014-B09 | QDIQMTQSPSSLSASVGDRVTITCRTGQSFSNFLNW YQQKPGTAPNLLIYLASNLQSGVPSRFSGSRSGTDF TLTISSLQPEDSAIYYCQQSHSLPWTFGQGTKVEIK |
| 539A-M0014-D11 | QDIQMTQSPGTLSLSPGQRATLSCRASQTVNSNYIA WYQQRPGQAPRLLIYAASSRATGIPDRFSGSGSGTD FTLTIRSLEPEDFAVYYCQKYGRSPQTFGQGTKVEI K |
| 539A-M0015-G04 | QSALTQPPSTSGTPGQRVTISCSGSGSNIGSNPVNW YQQLPGAAPKLLIYSNDLRPSGVPDRFSGSKSGTSA SLAISGLQSEDEADYYCAAWDSLNGPWVFGGGTKL TVL |
| 539A-M0016-A02 | QDIQMTQSPATLSLSPGERATLSCRASQSVSSNLAW YQQKPGQAPRLLIYDASNRATGIPARFSGSGSGTDF TLTISSLEPEDFAVYYCQQRSNWPPLTFGGGTKVEI K |
| 539A-M0016-A04 | QDIQMTQSPATLSLSPGERATLSCRASQSVSSYLAW YQQKPGQAPRLLIYDASNRATGIPARFSGSGSGTDF TLTISSLEPEDFAVYYCQQRSNWPLTFGGGTKVEIK |
| 539A-M0016-C03 | QDIQMTQSPGTLSLSPGERATLSCRASQSVSSNYLA WYQQKPGQAPRLLIYGASSRATGISDRFSGSGSGTD FTLTISRLEPEDFAVYYCQQYGTSPETFGGGTKVEI K |
| 539A-M0016-C10 | QDIQMTQSPSSLSASVGDRVTITCRASQGISNYLAW YQQKPGKVPKLLIYAASTLQSGVPSRFSGSGSGTDF TLTISSLQPEDVATYYCQKYNSAPFTFGPGTKVDIK |
| 539A-M0016-D07 | QYELTQPPSVSVSPGQTASITCSGDKLGDKYASWYQ QKPGQSPVLVVYHDTRRPSGIPERFSGSNSGNTATL TISGTQAMDEADYYCQAWDDITAVVFGGGTKLTVL |
| 539A-M0016-F03 | QSELTQPRSVSGSPGQSVTISCTGTSNDVGEYNYVS WYQQHPGKAPKVMIYDVTRRPSGVPDRFSGSKSGNT ASLTISGLQADDEAHYYCCSYAGRYTYVFGSGTNVT VL |
| 539A-M0016-H09 | QDIQMTQSPGTLSLSSGERATLSCRASQSVSSNYLA WYQQKRGQAPRLLIYGASSRATGVPGRFSGSGSGTD FTLTISRLEPEDFAVYYCQQYGSSPRTFGQGTKLEI K |
| 539A-M0018-A05 | QDIQMTQSPLSLPVTPGEPASISCRSSQSLLHSNGY NYLDWYLQKPGQSPQLLIYLGSNRASGVPDRFSGSG SGTDFTLKISRVEAEDVGVYYCMQALQTPYTFGQGT KLEIK |
| 539A-M0018-D01 | QDIQMTQSPSSLSASVGDRVTITCRASQSISIYLNW YQQKAGKAPKLLIYAASNLQSGVPSRFSGSGSGTDF TLTISSLQPEDFATYFCQQSYLPPLTFGGGTTVEIK |
| 539A-M0019-A10 | QDIQMTQSPSSLSASVGDRVTIACRASRFITTALGW YQQKSGTPPKLLIYDASYLDSGVPSRFSGSGSGTDF TLTINSVQPEDFATYYCQQFMTYPQGISFGQGTRLE IK |
| 539A-M0019-C07 | QSELTQPASVSGSPGQSITISCTGTSSDIGGYDYVS WYQQYPGKAPKLMIYHVSNRPSGVSTRFSGSKSANT ASLTISGLQAEDEADYYCSSYTSSSTYVFGTGTKVT VL |
| 539A-M0019-G07 | QDIQMTQSPSSLSASVGDRVTITCRASQSISTKLNW YQQKPGKAPNLLIYDTSTLQSGVPSRFSGSGSGTDF TLTISSLQLEDFASYYCQQTYGALTWTFGQGTKVEI K |
| 539A-M0019-G10 | QDIQMTQSPGTLSLSPGERATLSCRASQSVSSSYAA WYQLKPGQAPRLLIYGVSRRATGIPDRFSGSGSGTD FTLTISRLEPEDFAVYYCQQFGSSPTFGQGTKVEIK |
| 539A-M0020-C08 | QDIQMTQSPDSLSASVGDRVTITCRASQSISSYLNW YQQKPGKAPKLLIYAASSLQSGVPSRFSGSGSGTDF TLTISSLQPEDFATYYCQQSYSSPGITFGPGTKVEI K |
| 539A-M0020-H02 | QDIQMTQSPGTLSLSPGERATLSCRASQSVSSSYLA WYQQKPGQAPRLLIYGASSRATGIPDRFSGSGSGTD FTLTISRLEPEDFAVYYCQQYGSSLALTFGGGTKVE IK |
| 539A-M0021-B03 | QDIQMTQSPSSLSASVGDRVTITCRASQSISGSLNW YQQKPGKAPKLLIYAASILQSGVPSRFSGSGSGTDF TLTISSLQPEDFATYYCQQNYDLFGGLTFGPGTKVD VK |
| 539A-M0021-D06 | QDIQMTQSPSSLSASVGDRVTITCRTSQDFSNNLAW YQQRPGKAPKLLIYAASTLQSGVPSRFSGSGSGTDF TLTISSLQPEDVATYYCQRYDNGPLFGPGTKVHVK |
| 539A-M0021-E12 | QDIQMTQSPGTLSVSPGERATLSCRASQSVSSNLAW YQQKPGKAPRLLIYGASTRATGIPARFSGSGSGTEF TLTISSLQSEDFAVYYCQLYKTFGGGTKVEIK |

-continued

| Initial Name: | L-Variable (AA) (SEQ ID NOS 1870-1938): |
|---|---|
| 539A-M0021-G07 | QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKLEIK |
| 539A-M0022-A02 | QDIQMTQSPSSLSASVGDRVTITCRASQSISSYLNWYQQKPGKAPKLLIYAASSLQIGVPSRFSGSGSGTDFTLTISSLQPEDFATYYCQQSYITPLTFGPGTKVDIK |
| 539A-M0023-B11 | QDIQMTQSPSSLSASVGDRVTITCRANQGISNYLAWFQQKPGKAPKSLIYAASSLQSGVPSKFSGSGSGTDFTLTISSLQPEDSATYYCQQYNSFPLTFGGGTKVEIK |
| 539A-M0023-D03 | QDIQMTQSPATLSLSPGERATLSCRASQSVSSYLAWYQQKPGQAPRLLIYDASYRATGIPARFGGSGSGTDFTLTISSLEPEDFALYYCQQRSDWPRTFCQGTKLEIK |
| 539A-M0023-D05 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLDWFGGGTKLTVL |
| 539A-M0023-E09 | QSELTQPPSVSGSPRQSVTISCTGTTSDIGGYNHVSWYQHHPGKAPQLLIYDVTRRPSGVPDRFSASKSGNTASLTISGLQAEDEAVYYCSSYGGSYSFHVFGTGTQVTVL |
| 539A-M0023-H01 | QDIQMTQSPGTLSLSPGETATLSCWASQSVAWYQQKPGQPPRLLIYDVSTRATGIPDRFSGSGSGTGSTLTISRLEPEDFAVYFCQQYGYSPLSFDGGTKVEIKRTVAAP |
| 539A-M0024-C02 | QSELTQDPAVSVALGQTVRITCRGDRLRTYYSSWYQQKPRQAPVLVMFGRNNRPSGIPDRFSGSTSGGTASLTITATQADDEADYFCSSRDGSGNFLFGGGTKLTVL |
| 539A-M0025-F02 | QDIQMTQSPLSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK |
| 539A-M0025-G01 | QSELTQPASVSGSPGQSVTISCSGISYDLYDYIYVSWYQQHPDKAPQLLLYDVDKRPSGISDRFSGSKSGDTASLTISGLRTDDEAEYYCSSFTRTTTVYVFGTGTKVTVL |
| 539A-M0025-H03 | QDIQMTQSPSSLSASVGDRVTITCRASQSISSYLNWYQQKPGKAPKLLIYAASKLEDGVPSRFSGSGTGTDFTLTIRSLQPEDFASYFCQQSYSSPGITFGPGTKVEIK |
| 539A-M0025-H11 | QDIQMTQSPGTLSLSPGERATLSCRASQSVSSSYLAWYQQKPGQAPRLLIYGASSRATGIPDRFSGSGSGTDFTLTISRLEPEDIAVYYCQQYGSSAWTFGQGTKVEIK |
| 539A-M0026-A01 | QDIQMIQSPSSLSASVGDSVTITCRASQNINIYLNWYQQKPGKAPKLLISAASSLQSGVPSRFSGSGSGTDFTLTITDLQPEDLATYYCQQTYSAPPPWTFGPGTKVDIK |
| 539A-M0026-A05 | QDIQMTQSPATLSLSPGERATLSCRASQSVSRYLAWYQQKPGQAPRLLIYGASSRVHGIPDRFSGSGSGTDFTLTISRLEPEDFAVYYCQQYGSSPTTFGGGTKVEIK |
| 539A-M0026-A09 | QDIQMTQSPLSLPVTLGQPASISCRSSQSLVYINGNTYLNWFQQRPGQSPRRLIYNVSNRDSGVPERFSGSGSGTDFTLKISRVEAEDVGVYYCMQGTHWPPAFGQGTKVEIK |
| 539A-M0026-A10 | QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPPMYTFGQGTKLEIK |
| 539A-M0026-B11 | QDIQMTQSPSSLSASVGDRVAITCRASQSIDTYLNWYQQKPGKAPKLLIYAASKLEDGVPSRFSGSGTGTDFTLTIRSLQPEDFASYFCQQSYSSPGITFGPGTKVEIK |
| 539A-M0026-C03 | QSALTQPASVSGSPGQSITISCTGTSTDVGGYKYVSWYQQHPGKAPKLVIYEVSNRPSGVSNRFSGSKSGNTASLTISGLQAEDEADYYCSSYTSSTTVVFGGGTKLTVL |
| 539A-M0026-C07 | QSELTQPPSASGTPGQRVTISCSGSSSNIGTNTVNWYQQLPGMAPKVVMSANNERPSGVPDRFSGSKTGTSASLAISGLQSEDEADYYCAAWDENLSGPVFGTGTKVTVL |
| 539A-M0026-E01 | QDIQMTQSPATLSLSPGERATLSCRASQNVYSRLAWYQQKPGQAPRLLIYGASTRATGIPDRFSGSGSGTDFTLTISRLEPEDFALYYCQQYGSSPRTFGQGTKLEIR |
| 539A-M0026-E11 | QDIQMTQSPGTLSLSPGERATLSCRASQTISSNQLAWYQQQKPGQAPRLLVYGAFSTATGIPDRFIGGGSGTDFTLTISRLEPEDFAVYYCQQYGSSPLTFGGGTKVEIK |
| 539A-M0026-F03 | QDIQMTQSPGTLSLSPGESATLSCRASHSVDRLYLAWYQQKPGQAPRLLIYGTSSRATGIPDRVSGSGSGTDFTLTISRLEREDSAVYYCQHYGSLWTFGQGTKVEIK |
| 539A-M0026-F04 | QDIQMTQSPSSLSASVGDRVTITCRASQRIASYLNWYQQKFGKAPKLLIYAASSLQSCVPSRFSGSGSGTDFTLTVSSLQPEDFATYYCQQSYSAPLTFGGGTKVEIK |
| 539A-M0026-G12 | QDIQMTQSPSSLSASVGDRVTITCRASQSISSYLNWYQQKPGKAPKLLIYAASSLQSGVPSRFSGSGSGTDFTLTISSLQPEDFATYYCQSGLTFGGGTKVEIK |
| 539A-M0026-H05 | QDIQMTQSPSSLSASVDGRVTITCRASQSISSYLNWYQQKPGKAPKLLIYAASSLQSGVPSRFSGSGSGTDFTLTISSLQPEDFATYYCQQSYSTPYTFGQGTKLEIK |
| 539A-M0027-A08 | QSVLTQPASVSGSPCQSITISCTGTSTDVGGYNYVSWYQQHPGKAPKLMIYDVSNRPSGVSNRFSCSKSGNTASLTISGLQAEDEADYYCSSYTNTITWFGGGTKLTVL |
| 539A-M0027-B03 | QDIQMTQSPSSLSASVGDRVTITCRASQGIRNDLGWYQQKPGKAPKLLIYAASSLQSGVPSRFSGSGFGTDFTLTISSLQPEDFATYYCLQDYRYPLTFGGGTKVEIK |
| 539A-M0027-B08 | QDIQMTQSPSSLSASVGDRVAITCRASQSIDTYLNWYQQKPGKAPKLLIYAASKLEDGVPSRFSGSGTGTDFTLTIRSLQPEDFASYFCQQSYSSPGITFGPGTKVEIK |
| 539A-M0027-C07 | QDIQMTQSPSSLSASVGDRVTITCRASQSISSYLNWYQQKPGKAPKLLIYAASKLEDGVPSRFSGSGSGTDFTLTINSLQPEDFATYYCQQSYNTPSFGPGTRVDVK |
| 539A-M0027-G02 | QDIQMTQSPATLSASVGDRVTITCRASQRISSYLNWYQQKPGKAPKLLIYAASSLQSGVPSRFSGSGSGTDFTLTISSLQPEDFATYYCQQSYSTPRTFGQGTKVEIK |
| 539A-M0027-H04 | QDIQMTQSPSSLSASVGDRVTITCRASQDISSWLVWYQQKPGKAPKVLIYAASSLQSGIPSRFSGSGSGTDFTLTISSLQPEDFATYYCQQANRFPLTFGGGTKVEIK |
| 539A-M0028-E09 | QDIQMTQSPATLSVSPGERATLSCRASQSVSSSLAWYQQKPGQAPRLLISETSNRATAIPAKFSGSGFGTDFTLTISSLEPEDSAVYYCQQHVSWPLTFGGGTKVEIK |
| 539A-M0028-F04 | QSALTQPPSVSCAPGQTVTISCTGTSSNIGTGYAVHWYQHLPGKAPKPLFSGDDNRPSGVPDRFSASKGTSASLAIARLQTEDEADYYCESYDYKLGGWVFGGGTKLTVL |

MMP-12 Binders (These are in the Same Order as the Light Chain Sequences Provided Above)

```
H-Variable (AA) (SEQ ID NOS 1939-2008):
EVQLLESGGGLVQPGGSLRLSCAASGFTFSYYKMHWVRQAPGKGLEWVSW
IGPSGGITDYADSVKGRFTISRDNSKNTLYLQMSLRAEDTAVYYCTTDDI
SDYYGMDVWGQGTTVTVSS EVQLLESGGGLVQPGGSLRLSCAASGFTFSWYPMNWVRQAPGKGLEWVSV
IWPSGGETAYADSVKGRFTISRDNSKNTLYLQMNSLRAEDTAVYYCTTGR
FYGYYRDFDYWGWGTLVTVSS EVQLLESGGGLVQPGGSLRLSCAASGFTFSWYDMLWVRQAPGKGLEWVSY
ISPSGGYTLYADSVKGRFTISRDNSKNTLYLQMNSLRAEDTAVYYCTTVP
TPYTYCSGGSCYRDAFDIWGQGTMVTVSS EVQLLESGGGLVQPGGSLRLSCAASGFTFSYYPMYWVRQAPGKGLEWVSV
IGSSGGNTSYADSVKGRFTISRDNSKNTLYLQMNSLRAEDTAVYYCAGAH
YDFWSDYYGPDAFDIWGQGTMVTVSS EVQLLESGGGLVQPGGSLRLSCAASGFTFSWYLMGWVRQAPGKGLEWVSS
IYPSGGITNYADSVKGRFTISRDNSKNTLYLQMNSLRAEDTAVYYCARGG
GADAFGIWGQGTMVTVSS EVQLLESGGGLVQPGGSLRLSCAASGFTFSRYHMTWVRQAPGKGLEWVSS
ISPSGGPTYYADSVKGRFTISRDNSKNTLYLQMNSLRAEDTAVYYCAKGV
RSYYDFWSGYSLYYYYYGMDVWGQGTTVTVSS EVQLLESGGGLVQPGGSLRLSCAASGFTFSGYNMVWVRQAPGKGLEWVSI
VSSGGLTDYADSVKGRFTISRDNSKNTLYLQMNSLRAEDTAVYYCAKGLY
YYDSSGYYYGGAFDIWGQGTMVTVSS EVQLLESGGGLVQPGGSLRLSCAASGFTFSTYQMWWVRQAPGKGLEWVSG
ISSSGGATGYADSVKGRFTISRDNSKNTLYLQMNSLRAEDTAVYYCTRVP
HYYDSSGYYGGLVDYWGQGTLVTVSS EVQLLESGGGLVQPGGSLRLSCAASGFTFSRYLMHWVRQAPGKGLEWVSS
ISSSGGETDYADSVKGRFTISRDNSKNTLYLQMNSLRAEDTAVYYCAHGA
PLGDYYYYGMDVWGQGTTVTVSS EVQLLESGGGLVQPGGSLRLSCAASGFTFSRYGMTWVRQAPGKGLEWVSG
ISPSGGNTWYADSVKGRFTISRDNSKNTLYLQMNSLRAEDTAVYYCTSHD
YGDHYGMDVWGQGTLVTVSS EVQLLESGGGLVQPGGSLRLSCAASGFTFSGYDMKWVRQAPGKGLEWVSY
ISSSGGPTVYADSVKGRFTISRDNSKNTLYLQMNSLRAEDTAVYYCATEL
YDSSGYLSLWGQGTLVTVSS EVQLLESGGGLVQPGGSLRLSCAASGFTFSDYNMHWVRQAPGKGLEWVSY
IGPSGGYTHYADSVKGRFTISRDNSKNTLYLQMNSLRAEDTAVYYCAKDI
RGAYSSGLFDYWGRGTLVTVSS EVQLLESGGGLVQPGGSLRLSCAASGFTFSQYPMVWVRQAPGKGLEWVSS
IYPSGGYTIYADSVKGRFTISRDNSKNTLYLQMNSLRAEDTAVYYCARGG
GNFDYWGQGTLVTVSS EVQLLESGGGLVQPGGSLRLSCAASGFTFSWYNMFWVRQAPGKGLEWVSY
ISPSGGPTDYADSVKGRFTISRDNSKNTLYLQMNSLRAEDTAVYYCASEY
RGNYYGMDVWGQGTTVTVSS EVQLLESGGGLVQPGGSLRLSCAASGFTFSMYYMMWVRQAPGKGLEWVSG
IYPSGGPTGYADSVKGRFTISRDNSKNTLYLQMNSLRAEDTAMYYCASND
YGYYYGMDVWGQGTTVTVSS EVQLLESGGGLVQPGGSLRLSCAASGFTFSYYHMHWVRQAPGKGLEWVSG
IGPSGGMTYYADSVKGRFTISRDNSKNTLYLQMNSLRAEDTAVYYCARFN
YYYGLDVWGQGTTVTVSS EVQLLESGGGLVQPGGSLRLSCAASGFTFSHYQMDWVRQAPGKGLEWVSG
ISSSGGNTQYADSVKGRFTISRDNSKNTLYLQMNSLRAEDTAVYYCASQD
YGRYYGMDVWGQGTTVTVSS EVQLLESGGGLVQPGGSLRLSCAASGFTFSVYPMQWVRQAPGKGLEWVSG
ISSSGGFTMYADSVKGRFTISRDNSKNTLYLQMNSLRAEDMAVYYCARGG
DSLYGMDVWGQGTHGHRLK EVQLLESGGGLVQPGGSLRLSCAASGFTFSWYEMTWVRQAPGKGLEWVSY
IGPSGGRTVYADSVKGRFTISRDNSKNTLYLQMNSLRAEDTAVYYCALVS
QGEISGLPYGMDVWGQGTTVTVSS EVQLLESGGGLVQPGGSLRLSCAASGFTFSYYLMNWVRQAPGKGLEWVSS
IGSSGGFTYYADSVKGRFTISRDNSKNTLYLQMNSLRAEDTATYYCASND
YGYYYGMDVWGQGTTVTVSS EVQLLESGGGLVQPGGSLRLSCAASGFTFSRYNMVWVRQAPGKGLEWVSS
ISSSGGRTKYADSVKGRFTISRDNSKNTLYLQMNSLRAEDTAVYYCVTLD
LGYYYGMDVWGQGTTVTVSS EVQLLESGGGLVQPGGSLRLSCAASGFTFSSYDMTWVRQAPGKGLEWVSG
IVSSGGLTAYADSVKGRFTISRDNSKNTLYLQMNSLRAEDTAVYYCAKFN
ADFWSGYYNLGLDYWGQGTLVTVSS EVQLLESGGGLVQPGGSLRLSCAASGFTFSYYQMNWVRQAPGKGLEWVSV
ISPSGGITIYADSVKGRFTISRDNSKNTLYLQMNSLRAEDTAVYYCATAN
GYYDSSGYYYKDAFDIWGQGTMVTVSS EVQLLESGGGLVQPGGSLRLSCAASGFTFSWYGMTWVRQAPGKGLEWVSR
IYSSGGQTMYADSVKGRFTISRDNSKNTLYLQMNSLRAEDTAVYYCAREA
GIAAAGSYYYYYGMDVWGQGTTVTVSS EVQLLESGGGLVQPGGSLRLSCAASGFTFSHYWMHWVRQAPGKGLEWVSS
ISSSGGMTYYADSVKGRFTISRDNSKNTLYLQMNSLRAEDTAVYYCTTAD
YGYYYGMDVWGQGTTVTVSS EVQLLESGGGLVQPGGSLRLSCAASGFTFSLYWMKWVRQAPGKGLEWVSG
ISPSGGPTDYADSVKGRFTISRDNSKNTLYLQMNSLRAEDTATYYCATGD
TLLWFGELTDYWGQGTLVTVSS

EVQLLESGGGLVQPGGSLRLSCAASGFTFSKYNMMWVRQAPGKGLEWVSY
```

IWSSGGDTLYADSVKGRFTISRDNSKNTLYLQMNSLRAEDTAVYYCARVG

YGYGGPLYYYYYMDVWGKGTTVTVSS

EVQLLESGGGLVQPGGSLRLSCAASGFTFSFYWMAWVRQAPGKGLEWVSS

IGPSGGATDYADSVKGRFTISRDNSKNTLYLQMNSLRAEDTAVYYCARTN

YYDRGGSFDIWGQGTMVTVSS

EVQLLESGGGLVQPGGSLRLSCAASGFTFSQYDMQWVRQAPGKGLEWVSR

IGPSGGNTYADSVKGRFTISRDNSKNTLYLQMNSLRAEDTAMYYCARIN

VYYDSSGYYYGMDVWGQGTTVTVSS

EVQLLESGGGLVQPGGSLRLSCAASGFTFSHYSMSWVRQAPGKGLEWVSV

IYPSGGETDYADSVKGRFTISRDNSKNTLYLQMNSLRAEDTAVYYCTRDQ

GVDYGDYYFYYYYGMDVWGQGTTVTVSS

EVQLLESGGGLVQPGGSLRLSCAASGFTFSWYWMWVRQAPGKGLEWVSSI

RPSGGFTKYADSVKGRFTISRDNSKNTLYLQMNSLRAEDTAVYYCAAVGW

KGISTGLDYYYYYMDVWGKGTTVTVSS

EVQLLESGGGLVQPGGSLRLSCAASGFTFSAYEMIWVRQAPGKGLEWVSY

IYSSGGWTSYADSVKGRFTISRDNSKNTLYLQMNSLRAEDTATYYCARRG

LHYDSSGYYLGDYFDYWGQGTLVTVSS

EVQLLESGGGLVQPGGSLRLSCAASGFTFSSYHMDWVRQAPGKGLEWVSS

ISSSGGDTYYADSVKGRFTISRDNSKNTLYLQMNSLRAEDTAVYYCAKGL

NYYDSNDYYEVPYYYYGMDVWGQGTTVTVSS

EVQLLESGGGLVQPGGSLRLSCAASGFTFSEYAMVWVRQAPGKGLEWVSS

IVPSGGTTQYADSVKGRFTISRDNSKNTLYLQMNSLRAEDTAVYYCARVN

VHYDILTGYYAYYYYGMDVWGQGTTVTVSS

EVQLLESGGGLVQPGGSLRLSCAASGETFSDYPMQWVRQAPGKGLEWVSS

IGSSGGFTQYADYVKGRFTISRDNSKNTLYLQMNSLRAEDTAVYYCAKGS

QDYDSSGYYYYYMDVWGKGTTVTVSS

EVQLLESGGGLVQPGGSLRLSCAASGFTFSAYEMIWVRQAPGKGLEWVSY

IYSSGGWTSYADSVKGRFTISRDNSKNTLYLQMNSLRAEDTATYYCARRG

LHYDSSGYYLGDYFDYWGQGTLVTVSS

EVQLLESGGGLVQPGGSLRLSCAASGFTFSHYTMDWVRQAPGKGLEWVSS

IGPSGGITGYADSVKGRFTISRDNSKNTLYLQMNSLRAEDTATYYCATSS

GWYWDYFDYWGQGTLVTVSS

EVQLLESGGGLVQPGGSLRLSCAASGFTFSKYMNHWVRQAPGKGLEWVSW

IWPSGGVTMYADSVKGRFTISRDNSKNTLYLQMNSLRAEDTAVYYCARWG

HYGGNDYWGQGTLVTVSS

EVQLLESGGGLVQPGGSLRLSCAASGFTFSFYSMGWVRQAPGKGLEWVSS

ISSSGGYTDYADSVKGRFTISRDNSKNTLYLQMNSLRAEDTAVYYCAREF

SSWYSYMDVWGKGTTVTVSS

EVQLLESGGGLVQPGGSLRLSCAASGFTFSRYHMSWVRQAPGKGLEWVSS

IRSSGGSTPYADSVKGRFTISRDNSKNTLYLQMNSLRAEDTAVYYCARGP

QLSTFDIWGQGTMVTVSS

EVQLLESGGGLVQPGGSLRLSCAASGFTFSKYEMIWVRQAPGKGLEWVSS

IYPSGGHTQYADSVKGRFTISRDNSNTLYLQMNSLRAEDTAVYYCARGFY

GDYDYYYYYGMDVWGQGTTVTVSS

EVQLLESGGGLVQPGGSLRLSCAASGFTFSWYEMYWVRQAPGKGLEWVSW

IGPSGGFTHYADSVKGRFTISRDNSKNTLYLQMNSLRAEDTALYYCATRG

YSYDFEGWYFDLWGRGTLVTVSS

EVQLLESGGGLVQPGGSLRLSCAASGFTFSDYKMQWVRQAPGKGLEWVSV

ISSSGGHTAYADSVKGRFTISRDNSKNTLYLQMNSLRAEDTAVYYCARET

YYYDSSGYYGGAFDIWGQGTMVTVSS

EVQLLESGGGLVQPGGSLRLSCAASGFTFSNYMMLWVRQAPGKGLEWVSS

IWSSGGYTEYADSVKGRFTISRDNSKNTLYLQMNSLRAEDTAVYYCARGD

MTTVVRNAFDIWGQGTMVTVSS

EVQLLESGGGLVQPGGSLRLSCAASGFTFSGYGMWWVRQAPGKGLEWVSS

IGSSGGFTVYADSVKGRFTISRDNSKNTLYLQMNSLRAEDTAMYYCARGY

HYYDSSGYYYGFEAFDIWGQGTMVTVSS

EVQLLESGGGLVQPGGSLRLSCAASGFTFSGYDMAWVRQAPGKGLEWVSS

IGPSGGGTMYADSVKGRFTISRDNSKNTLYLQMNSLRAEDTAMYYCARRM

ESYYDSYDYWGQGTLVTVSS

EVQLLESGGGLVQPGGSLRLSCAASGFTFSWYDMRWVRQAPGKGLEWVSS

ISPSGGVTTYADSVKGRFTISRDNSKNTLYLQMNSLRAEDTAVYYCTTDE

LSWDGDPYYMDVWGKGTTVTVSS

EVQLLESGGGLVQPGGSLRLSCAASGFTFSVYDMIWVRQAPGKGLEWVSY

ISSSGGGTEYADSVKGRFTISRDNSKNTLYLQMNSLRAEDTAVYYCARGG

SYYETAFDIWGQGTMVTVSS

EVQLLESGGGLVQPGGSLRLSCAASGFTFSNYVMSWVRQAPGKGLEWVSS

IGSSGGETAYADSVKGRFTISRDNSKNTLYLQMNSLRAEDTAVYYCATVY

SYDNSGRLYSFYSFYSWGQGTLVTVSS

EVQLLESGGGLVQPGGSLRLSCAASGFTFSYYNMMWVRQAPGKGLEWVSS

ISSSGGGTDYADSVKGRFTISRDNSKNTLYLQMNSLRAEDTAVYYCTRLG

QWSSGQYYFDYWGQGTLVTVSS

EVQLLESGGGLVQPGGSLRLSCAASGFTFSYYYMVWVRQAPGKGLEWVSS

IGSSGGDTLYADSVKGRFTISRDNSKNTLYLQMNSLRAEDTAVYYCARVI

DSWATAFDIWGQGTMVTVSS

EVQLLESGGGLVQPGGSLRLSCAASGFTFSEYQMGWVRQAPGKGLEWVSS

IVPSGGLTKYADSVKGRFTISRDNSKNTLYLQMNSLRAEDTAVYYCARGS

GYYKDSHFDYWGQGTLVTVSS

EVQLLESGGGLVQPGGSLRLSCAASGFTFSAYEMIWVRQAPGKGLEWVSY

IYSSGGWTSYADSVKGRFTISRDNSKNTLYLQMNSLRAEDTATYYCARRG

LHYDSSGYYLGDYFDYWGQGTLVTVSS

EVQLLESGGGLVQPGGSLRLSCAASGFTFSIYEMEWVRQAPGKGLEWVSV

```
ISPSGGGTDYADSVKGRFTISRDNSKNTLYLQMNSLRAEDTATYYCARVR
WDDFWTGYYYGMDVWGQGTTVTVSS
EVQLLESGGGLVQPGGSLRLSCAASGFTFSNYAMQWVRQAPGKGLEWVSS
IWPSGGLTDYADSVKGRFTISRDNSKNTLYLQMNSLRAEDTAVYYCAREG
ISYDAFDIWGQGTMVTVSS
EVQLLESGGGLVQPGGSLRLSCAASGETFSQYTMAWVRQAPGKGLEWVSG
IYSSGGGTHYADSVKGRFTISRDNSKNTLYLQMNSLRAEDTAVYYCARGG
GSSWYFGDAFDIWGQGTMVTVSS
EVQLLESGGGLVQPGGSLRLSCAASGFTFSAYAMYWVRQAPGKGLEWVSG
ISPSGGGTEYADSVKGRFTISRDNSKNTLYLQMNSLRAEDTAVYYCAREA
HYYDSSGYYSGAFDIWGQGTMVTVSS
EVQLLESGGGLVQPGGSLRLSCAASGFTFSLYYMVWVRQAPGKGLEWVSG
IYPSGGVTSYADSVKGRFTISRDNSKNTLYLQMNSLRAEDTAVYYCTTAN
GYYDSSGYYYKDAFDIWGQGTMVTVSS
EVQLLESGGGLVQPGGSLRLSCAASGFTFSAYEMRWVRQAPGKGLEWVSR
IGPSGGNTQYADSVKGRFTISRDNSKNTLYLQMNSLRAEDTAVYYCTAAD
YGDYYGMDVWGQGTTVTVSS
EVQLLESGGGLVQPGGSLRLSCAASGFTFSMYDMGWVRQAPGKGLEWVSY
IGSSGGMTTYADSVKGRFTISRDNSKNTLYLQMNSLRAEDTAVYYCARRM
ESYYDSYDYWGQGTLVTVSS
EVQLLESGGGLVQPGGSLRLSCAASGFTFSSYMMWVRQAPGKGLEWVSYI
SPSGGTTSYADSVKGRFTISRDNSKNTLYLQMNSLRAEDTAVYYCAHSWG
SRFDPWGQGTLVTVSS
EVQLLESGGGLVQPGGSLRLSCAASGFTFSYYQMMWVRQAPGKGLEWVSS
IGPSGLTEYADSVKGRFTISRDNSKNTLYLQMNSLRAEDTAVYYCARDGA
TYYDFWDYWGQGTLVTVSS
EVQLLESGGGLVQPGGSLRLSCAASGFTFSPYAMYWVRQAPGKGLEWVSS
IWPSGGSTNYADSVKGRFTISRDNSKNTLYLQMNSLRAEDTAVYYCARES
EIDAFDIWGQGTMVTVSS
EVQLLESGGGLVQPGGSLRLSCAASGFTFSAYEMIWVRQAPGKGLEWVSY
IYSSGGWTSYADSVKGRFTISRDNSKNTLYLQMNSLRAEDTATYYCARRG
LHYDSSGYYLGDYFDYWGQGTLVTVSS
EVQLLESGGGLVQPGGSLRLSCAASGFTFSWYYMAWVRQAPGKGLEWVSV
IGPSGGDTKYADSVKGRFTISRDNSKNTLYLQMNSLRAEDTAVYYCTRVS
PLDYYDSSGYYFGYYYYYGMDVWGQGTTVTVSS
EVQLLESGGGLVQPGGSLRLSCAASGFTFSAYEMIWVRQAPGKGLEWVSY
IYSSGGWTSYADSVKGRFTISRDNSKNTLYLQMNSLRAEDTATYYCARRG
LHYDSSGYYLGDYFDYWGQGTLVTVSS
EVQLLESGGGLVQPGGSLRLSCAASGFTFSFYGMGWVRQAPGKGLEWVSW
ISSSGGDTYYADSVKGRFTISRDNSKNTLYLQMNSLRAEDTAVYYCARDR
DNWNDAADYWGQGTLVTVSS
EVQLLESGGGLVQPGGSLRLSCAASGFTFSLYPMSWVRQAPGKGLEWVSS
ISSSGGHTKYADSVKGRFTISRDNSKNTLYLQMNSLRAEDTAVYYCALYS
YYYGMDVWGQGTTVTVSS
EVQLLESGGGLVQPGGSLRLSCAASGFTFSVYGMNWVRQAPGKGLEWVSY
ISPSGGTYYADSVKGRFTISRDNSKNTLYLQMNSLRAEDTAVYYCARGGY
YSNSLDFYYYYYGMDVWGQGTTVTVSS
EVQLLESGGGLVQPGGSLRLSCAASGFTFSNYAMQWVRQAPGKGLEWVSY
IGPSGGETGYADSVKGRFTISRDNSKNTLYLQMNSLRAEDTAVYYCARDL
RGNYYDSSGYTDAFDIWGQGTMVTVSS
```

2. MMP12 Inhibitors (SEQ ID NOS 2009-2020)

```
539A-M0013-D11   QDIQMTQSPSSLSASVGDRITISCQASQDIDNYLNW
                YQQRSGKAPKLLIYDAYNLKAGVPSRFRGSRSGTDF
                FLTISSLQPEDFATYYCQQSYRAPLTFGGGTKVEIK
539A-M0013-G12   QDIQMTQSPSSLSASVGDRVTITCQASQDTYNRLHW
                YQQKPGKAPKLLIYDAVNLNRGVPSRFRGSGSGTNY
                ILIITNLQPEDTATYYCQHSDDLSLAFGGGTKVEIK
539A-M0013-H06   QDIQMTQSPATLSLSPGERATLSCRASHSVDNLAWY
                QQQPGQAPRLLIYDVSYRATGIPARFSGSGSGTDFT
                LTISSLEPEDFAVYYCQQRNNWPLSLTFGGGTKVEI
                K
539A-M0014-C09   QDIQMTQSPATLSLSPGERATLSCGASQNIDGYYLA
                WYQQKPGQAPSLLIYDASSRSTGVPDRFSGSGSGTD
                FTLTISRLEPEDFAVYYCQHYGNSLWTFGQGTKVEI
                K
539A-M0014-G11   QYELTQPPSASGTPGQRITISCSGSSSNLGSNPVQW
                YQQLPGSAPKLLIHTNTHRPSGVPDRFSGSKSVTSA
                SLAISGLQSEDEAEYYCATWDDSLNGGVFGGGTKLT
                VL
539A-M0016-A11   QDIQMTQSPSSLSASVRDRVTITCRTSQNINTYLNW
                YYQAPGRAPKLLIFGVSSLHRGVSSRFSGSGDGTEF
                TLTISSLQPEDIGTYFCQQSYSSPWTFGQGTKVEIK
539A-M0016-H05   QDIQMTQSPATLSLSPGERATLSCRASQSVSSYLAW
                YQQKPGQAPRLLIYDASNRATGIPARFSGSGSGTDF
                TLTISSLEPEDFAVYYCQQRSNWPLTFGGGTKVEIK
539A-M0019-C05   QYELTQPRSVSGSPGQSVTISCTGSSSDVAGFYYVS
                WYQQHPGKAPKLMIRDVNDRPSGVSNRFSGSKSGNT
                ASLTIAGLQTEDEAVYYCSSTSRSDTRVIFGGGTKL
                TV
```

```
539A-M0020-B01  QYELTQPPSVSVAPGQTATITCEGNNIASKSVHWYQ
                QKPGQAPVLVVYDDRDRPSGISERISGSNSGNTPTL
                TIFRVEAGDEADYYCQVSDSATDHRVFGGGTKLTVL

539A-M0022-C07  QDIQMTQSPATLSVSPGERATLSCRASQNVRNYLAW
                YQQKPGQAPRLLIYDASKRATGIPARFSGSGSGTDF
                TLTISGLEPEDFAVYYCQQRSNWPTFGPGTKVDIK

539A-M0025-D04  QDIQMTQSPGTLSLSPGERATLSCRASQSVSSSYLA
                WYQQKPGQAPRLLIYGASSRATGIPDRFSGSGSGTD
                FTLTISRLEPEDFAVYYCQQYGSSLTFGGGTKVEIK

539A-M0027-E11  QDIQMTQSPDTLSLSPGERGTLSCRASQSLSSSYLA
                WYQQKPGQAPRLLIYDASSRATGIPDRFSGSGSGTD
                FTLTIGRLEPEDSAVYYCQQYGSFPLTFGGGTKVEI
                K
```

2. MMP12 Inhibitors Heavy Chain Sequences (Provided in the Same Roder as the Light Chains Provided Above) (SEQ ID NOS 2021-2023)

```
EVQLLESGGGLVQPGGSLRLSCAASGFTFSSYPMWVRQAPGKGLEWVSGIVPSGGV
TIYADSVKGRFTISRDNSKNTLYLQMNSLRAEDTAVYYCARVGMLASSDYYYYMDVWGKGTTVTVSS

EVQLLESGGGLVQPGGSLRLSCAASGFTFSWYHMFWVRQAPGKGLEWVSGISSSGGYTHYADSVKGRF
TISRDNSKNTLYLQMNSLRAEDTAVYYCATREGMLYDYVWGENYMDVWGKGTTVTVSS

EVQLLESGGGLVQPGGSLRLSCAASGFTFSAYEMDWVRQAPGKGLEWVSGISSSGGPTYYADSVKGRF
TISRDNSKNTLYLQMNSLRAEDTAVYYCARVGGWELLQDYYYYMDVWGKGTTVTVSS

EVQLLESGGGLVQPGGSLRLSCAASGFTFSDYSMHWVRQAPGKGLEWVSGIGPSGGPTFYADSVKGRF
TISRDNSKNTLYLQMNSLRAEDTAVYYCARGEYSSSDYYYYYGMDVWGQGTTVTVSS

EVQLLESGGGLVQPGGSLRLSCAASGFTFSWYVMVWVRQAPGKGLEWVSSIYSSGGPTKYADSVKGRF
TISRDNSKNTLYLQMNSLRAEDTAVYYCAKEGGVYGGPELYYYYYGMDVWGQGTTVTVSS

EVQLLESGGGLVQPGGSLRLSCAASGFTFSEYQMAWVRQAPGKGLEWVSSIYPSGGHTHYADSVKGRF
TISRDNSKNTLYLQMNSLRAEDTAVYYCAKESYYDFWSGYYFDYWGQGTLVTVSS

EVQLLESGGGLVQPGGSLRLSCAASGFTFSWYAMSWVRQAPGKGLEWVSRIVPSGGDTGYADSVKGRF
TISRDNSKNTLYLQMNSLRAEDTAVYYCATFRGIMYGDYGSSYWYFDLWGRGTLVTVSS

EVQLLESGGGLVQPGGSLRLSCAASGFTFSWYAMVWVRQAPGKGLEWVSYIGSSGGVTGYADSVKGRF
TISRDNSKNTLYLQMNSLRAEDTAVYYCARQKRVDYYDSSGYPTNAEFDYWGQGTLVTVSS

EVQLLESGGGLVQPGGSLRLSCAASGFTFSHYVMHWVRQAPGKGLEWVSYIGSSGGETRYADSVKGRF
TISRDNSKNTLYLQMNSLRAEDTAVYYCARADYGDYDYYYYYGMDVWGQGTTVTVSS

EVQLLESGGGLVQPGGSLRLSCAASGFTFSIYQMWWVRQAPGKGLEWVSSISSSGFTWYADSVKGRF
TISRDNSKNTLYLQMNSLRAEDTAVYYCTTEDIGYYYGMDVWGQGTTVTVSS

EVQLLESGGGLVQPGGSLRLSCAASGFTFSSYGMHWVRQAPGKGLEWVSGIVSSGGSTIYADSVKGRF
TISRDNSKNTLYLQMNSLRAEDTAVYYCTTYDYGDHYGMDVWGQGTTVTVSS

EVQLLESGGGLVQPGGSLRLSCAASGFTFSHYEMEWVRQAPGKGLEWVSSISSSGGPTMYADSVKGRF
TISRDNSKNTLYLQMNSLRAEDTAVYYCARGMYGDYDFYYYYGMDVWGQGTTVTVSS
```

1. MMP-12 Inhibitors-Light Chain

| Initial Name | LV-FR1 (SEQ ID NOS 2033-2058) | LV-CDR1 (SEQ ID NOS 2059-2084) | LV-FR2 (SEQ ID NOS 2085-2110) | LV-CDR2 (SEQ ID NOS 2110-2136) | LV-FR3 (SEQ ID NOS 2137-2162) | LV-CDR3 (SEQ ID NOS 2163-2188) | LV-FR4 (SEQ ID NOS 2189-2214) | L-Constant (SEQ ID NOS 2215-2240) |
|---|---|---|---|---|---|---|---|---|
| 539B-M0035-C05 | QSELTQPASVSGSPGQSITISC | TGTSSDVGGYNYLS | WYQQHPGKAPKLMIY | EVTNRPS | GVSNRFSGSKSGNTASLTISGLQAEDEADYYC | SSYTSTTTLL | FGGGTKLTVL | GQPKAAP |
| 539B-M0040-A02 | QDIQMTQSPATLSLSPGERATLSC | RASQSVSSSYLA | WYQQKPGQAPRLLIY | GASSRAT | GIPDRFSGSGSGTDFTLTISRLEPEDFAVYYC | QQYGSSPLT | FGGGTKVEIK | RTVAAPS |
| 539B-M0041-G04 | QYELTQPASVSGSPGQSITISC | TGTSSDVGGYNYVS | WYQQHPGKAPKLMIY | EVSNRPS | GVSNRFSGSKSGNTASLTISGLQAEDEADYYCR | SSYTSSSTLF | FGGGTKLTVL | GQPKAAP |
| 539B-M0007-A10 | QDIQMTQSPSSLSASVGDRVTITC | RASQRIASYLN | WYQQKPGKAPKLLIY | AASSLQS | GVPSRFSGSGSGTDFTLTVSSLQPEDFATYYC | QQSYSAPLT | FGGGTKVEIK | RTVAAPS |
| 539B-M0052-F03 | QDIQMTQSPSSLSASVGDRVTLTC | RTSENVERYLN | WYQHRPGKDASKLQTSPRLVIY | | GVPSRFTGRGSGTDFTLTINSLQPEDFATYYC | QQTSITPHT | FGQGTKLDVK | RTVAAPS |

-continued

| Initial Name | LV-FR1 (SEQ ID NOS 2033-2058) | LV-CDR1 (SEQ ID NOS 2059-2084) | LV-FR2 (SEQ ID NOS 2085-2110) | LV-CDR2 (SEQ ID NOS 2110-2136) | LV-FR3 (SEQ ID NOS 2137-2162) | LV-CDR3 (SEQ ID NOS 2163-2188) | LV-FR4 (SEQ ID NOS 2189-2214) | L-Constant (SEQ ID NOS 2215-2240) |
|---|---|---|---|---|---|---|---|---|
| 539B-M0041-A05 | QDIQMTQSPLSL PVTPGEPASISC | RSSQSLLHDN GYNYLD | WYLQKPGQ SPQLLIY | LGSNRAS | GVPDRFSGSGSGTDFT LKISRVEAEDVGVYYC | MQGLQTPLT | FGGGTKVEIK | RTVSAPS |
| 539B-M0034-C04 | QDIQMTQSPSSL SASVGDRVSITC | RASQNINSYL N | WYQQKVGK APKLLIF | GAYTLHS | GAPSRFSGSGSGTDFT LTISSLQPEDVATYYC | QQTYTSYS | FAQGTKLEIK | AAPSVFI |
| 539B-M0038-D06 | QSVLTQPPSASG TPGQRVTISC | SGTSPNIGSN TVS | WYQQLPGT APKLLIY | NNNQRPS | GVPDRFSGSKSGTSAS LAISGLQSEDEADYYC | VAWDDSLNGF V | LGTGTKVTVL | GQPKANP |
| 539B-M0007-H06 | QDIQMTQSPGTL SLSSGERATLSC | RASQSVSSNY LA | WYQQKRGQ APRLLIY | GASSRAT | GVPGRFSGSGSGTDFT LTISRLEPEDFAVYYC | QQYGSSPRT | FGQGTKLEIK | RTVAAPS |
| 539B-M0038-A03 | QSELTQPPSASG TPGQRVTISC | SGSSSNIGSN TVN | WYQQLPGT APKLLIY | SNNQRPS | GVPDRFSGSKSGTSAS LAISGLQSEDEADYYC | AAWDDSLNGR WV | FGGGTKLTVL | GQPKAAP |
| 539B-M0039-B02 | QYELTQPASVSG SPGQSITISC | TGTNSDIGDY NFVS | WYQQHPGK APKLMIS | EVSNRPS | GVSNRFSGSKSGNTAS LSISGLQAEDEAHYYC | SSYTSSSTPV V | FGGGTKLTVL | GQPKAAP |
| 539B-M0035-D06 | QSALTQSSSASA SLGSSVTLTC | TLSSGHGDYI IA | WHQQQPGK APRYLM | KLENSGSF KKGS | GVPDRFSGSSSGADRY LTISDLQSDDEADYYC | ETWDSNIRLV | FGGGTKLTVL | SQPKAAP |
| 539B-M0042-H01 | QDIQMTQSPSSL SASVGDRVAITC | RASQSIDTYL N | WYQQKPGK APKLLIY | AASKLED | GVPSRFSGSGTGTDFT LTIRSLQPEDFASYFC | QQSYSSPGIT | FGPGTKVEIK | RTVAAPS |
| 539B-M0040-C08 | QSALTQSSSASA SLGSSVTLTC | TLSSGHGDYI IA | WHQQQPGK APRYLM | KLENSGS FKKGS | GVPDRFSGSSSGADRY LTISDLQSDDEADYYC | ETWDSNIRLV | FGGGTKLTVL | SQPKAAP |
| 539B-M0038-F09 | QDIQMTQSPDSL SASVGDRVTITC | RASQSISTYL N | WYQQKPGK APKLLIY | AASSLQS | GVPSRFSGSGSGTDFT LTISSLQPEDFATYYC | QQSYSTPLT | FGGGTKVEIK | RTVAAPS |
| 539B-M0040-E08 | QSALTQPASVSG SPGQSITISC | TGTSSDVGGY NYVS | WYQQHPGK TPKLMIY | DVSNRPS | GVSNRFSGSKSGNTAS LTISGLQAEDEADYYC | SSYTSSSTLV | FGGGTKLTVL | GQPKAAP |
| 539B-M0034-E11 | QDIQMTQSPSSL SASVGDRVTITC | RASQRISSYL N | WYQQKPGK APKLLIY | AASSLQS | GVPSRFSGSGSGTDFT LTIRSLQPEDFATYYC | QQSYSSRWT | FGQGTKVEIQ | RTVAAPS |
| 539B-M0008-E08 | QYELTQPPSLSV SPGQTASITC | SGEKLGEKFA S | WYQRRPGQ SPLLIY | QDNKRPS | GIPERFSGSNSGNTAA LTITGTQAMDDADYYC | QAWESTTAV | FGGGTKLTVL | GQPKANP |
| 539B-M0039-F01 | QNIQMTQSPSSV SASVGDRVTITC | RASQDINYWL A | WYQQKPGK APKLLIY | AASSLQS | GVPSRFSGSGSGTDFT LTISSLQPEDFATYYC | QRANSFPYT | FGQGTKLEIK | RTVAAPS |
| 539B-M0030-A10 | QSELTQPASVSG SPGQSITISC | TGTSSDVGAY NYVS | WYQQHPGK VPKLMIY | EVSNRPS | GVSNRFSGSKSGNTAS LTISGLQAEDEADYYC | NSYTTSATLV | FGGGTKLTVL | SQPKAAP |
| 539B-M0052-E10 | QDIQMTQSPLSL PVTPGEPASISC | RSSQSLLYSN GYNYLD | WYLQKPGQ SPQLLIY | LGSNRAS | GVPDRFSGSGSGTDFT LKISRVEAEDVGVYYC | MQALQTPLT | FGGGTKVEIK | RTVAAPS |
| 539B-M0040-A03 | QYELTQPASVSG SPGQSITISC | TGTSSDIGGY NFVS | WYQQHPGR APKLTIY | EVNNRPS | GVSNRFSGSKSGNTAS LTISGLQAEDEADYYC | SSYTPSSTLV | FGTGTKVTVL | RQPKANP |
| 539B-M0040-B05 | QSVLTQPPSVSV APGQTARITC | GGNNIGSKTV N | WYQQKTGQ APVLVVH | DDSDRPS | GIPERLSGSNSGNTAT LTISRVEAGDEADYYC | QVWDSGTDHY V | FGTGTKVTVL | GQPKANP |
| 539B-M0041-G01 | QDIQMTQSPSSL SASVGDRVTITC | RASQSISYFL N | WYQQKPGK APKLLIY | AASTLQG | GVPSRFRGSGSGTDFT LTISSLQPEDFATYYC | QHSYSTPPIT | FGPGTKVDIK | RTVAAPS |
| 539B-M0038-H04 | QSELTQPHSVSE SPGTTVTISC | TSSSGNIASN YVQ | WYQQRPNS APTIVIY | AYNRRPS | GVPDRFSGSIDSSSNS ASLTVSGLKTEDEADY YC | QSYDNINRLW | FGGGTKLTVL | GQPKAAP |
| 539B-M0032-H09 | QDIQMTQSPSTL SASVGDRVTITC | RASQSISSWL A | WYQQKPGK APKLLIY | DASSLES | GVPSRFSGSGSGTEFT LTISSLQPEDIGTYYC | QQYDHLPT | FGGGTKVQVK | RTVAAPS |

1. MMP-12 Inhibitors-Heavy Chain Variable Sequences
(Provided in the Same Order as the Light Chains Provided
Above)

| HV-FR1 (SEQ ID NOS 2241-2266) | HV-CDR1 (SEQ ID NOS 2267-2292) | HV-FR2 (SEQ ID NOS 2293-2318) | HV-CDR2 (SEQ ID NOS 2319-2344) | HV-FR3 (SEQ ID NOS 2345-2370) | HV-CDR3 (SEQ ID NOS 2371-2396) | HV-FR4 (SEQ ID NOS 2397-2422) |
|---|---|---|---|---|---|---|
| EVQLLESGGGLVQPGGSLRLSCAASGFTFS | WYPMI | WVRQAPGKGLEWVS | SISSSGAYTHYADSVKG | RFTISRDNSKNTLYLQMNSLRAEDTAVYYCAR | EGVDTAMAFGY | WGQGTLVTVSS |
| EVQLLESGGGLVQPGGSLRLSCAASGFTFS | DYGMM | WVRQAPGKGLEWVS | SISPSGGDTHYADSVKG | RFTISRDNSKNTLYLQMNSLRAEDTAVYYCAR | WEAKVDAFDI | WGQGTTVTVSS |
| EVQLLESGGGLVQPGGSLRLSCAASGFTFS | DYPMS | WVRQAPGKGLEWVS | SISSSGGSTEYADSVKG | RFNISRDNSKNTLYLQMNSLRAEDTAMYYCAR | HPDGVARFDP | WGQGTLVTVSS |
| EVQLLESGGGLVQPGGSLRLSCAASGFTFS | EYAMR | WVRQAPGKGLEWVS | SISPSGGSTWYADSVKG | RFTISRDNSKNTLYLQMNSLRAEDTAVYYCAR | RGWAAAGYYYGMDV | WGQGTTVTVSS |
| EVQLLESGGGLVQPGGSLRLSCAASGFTFS | EYNMH | WVRQAPGKGLEWVS | SISPSGGNTRYADSVKG | RFTISRDNSKNTLYLQMNSLRAEDTAVYYCAR | DGVSKWYYHGIDV | WGQGTTVTVSS |
| EVQLLESGGGLVQPGGSLRLSCAASGFTFS | EYNMN | WVRQAPGKGLEWVS | GISSSGGQTMYADSVKG | RFTISRDNSKNTLYLQMNSLRAEDTAVYYCAR | GVAYDSKTPDI | WGRGTMVTVSS |
| EVQLLESGGGLVQPGGSLRLSCAASGFTFS | EYPMY | WVRQAPGKGLEWVS | VIYPSGGWTDYADSVKG | RFTISRDNSKNTLYLQMNSLRAEDTAVYYCAR | MAVTGGSRFDY | WGQGTLVTVSS |
| EVQLLESGGGLVQPGGSLRLSCAASGFTFS | FYAMT | WVRQAPGKGLEWVS | RIVPSGGDTMYADSVKG | RFTISRDNSKNTLYLQMNSLRAEDTAVYYCAR | DLGDYDFWSGTLYYGMDV | WGQGTTVTVSS |
| EVQLLESGGGLVQPGGSLRLSCAASGFTFS | HYWMH | WVRQAPGKGLEWVS | SISSSGGMTYYADSVKG | RFTISRDNSKNTLYLQMNSLRAEDTAVYYCTT | ADYGYYYGMDV | WGQGTTVTVSS |
| EVQLLESGGGLVQPGGSLRLSCAASGFTFS | IYMMG | WVRQAPGKGLEWVS | SISPSGGWTRYADSVKG | RFTISRDNSKNTLYLQMNSLRAEDTAVYYCTT | APYPNWNYHYFDY | WGQGTLVTVSS |
| EVQLLESGGGLVQPGGSLRLSCAASGFTFS | KYPMV | WVRQAPGKGLEWVS | SIGPSGGVTAYADSVKG | RFTISRDNSKNTLYLQMNSLRAEDTAMYYCAR | HSRDIAVDY | WGQGTLVTVSS |
| EVQLLESGGGLVQPGGSLRLSCAASGFTFS | MYAMV | WVRQAPGKGLEWVS | SISPSGGLTDYADSVKG | RFTISRDNSKNTLYLQMNSLRAEDTATYYCAN | PWPLTAELADI | WGQGTMVTVSS |
| EVQLLESGGGLVQPGGSLRLSCAASGFTFS | MYPMN | WVRQAPGKGLEWVS | RIVSSGGTTHYADSVKG | RFTISRDNSKNTLYLQMNSLRAEDTAVYYCTT | GDYSWDY | WGQGTLVTVSS |
| EVQLLESGGGLVQPGGSLRLSCAASGFTFS | PYDMT | WVRQAPGKGLEWVS | GIVPSGGFTSYADSVKG | RFTISRDNSKNTLYLQMNSLRVEDTAVYYCAR | RGVVGGLDY | WGQGTLVTVSS |
| EVQLLESGGGLVQPGGSLRLSCAASGFTFS | PYIMK | WVRQAPGKGLEWVS | YISSSGGITMYADSVKG | RFTISRDNSKNTLYLQMNSLRAEDTAVYYCAA | ENRVPFDY | WGQGTLVTVSS |
| EVQLLESGGGLVQPGGSLRLSCAASGFTFS | PYSMG | WVRQAPGKGLEWVS | GIGPSGGYTTYADSVKG | RFTISRDNFKNTLYLQMNSLRAEDTAVYYCAR | HPVGYDAFDI | WGQGTMVTVSS |
| EVQLLESGGGLVQPGGSLRLSCAASGFTFS | RYGML | WVRQAPGKGLEWVS | VIYPSGGPTLYADSVKG | RFTISRDNSKNTLYLQMNSLRAEDTAVYYCAR | DGVLRGSHIYFDY | WGQGTLVTVSS |
| EVQLLESGGGLVQPGGSLRLSCAASGFTFS | RYTMG | WVRQAPGKGLEWVS | RIYSSGGNTVYADSVKG | RFTISRDNSKNTLYLQMNSLRAEDTATYYCAR | TRRDGYNPFDY | WGQGTLVTVSS |
| EVQLLESGGGLVQPGGSLRLSCAASGFTFS | RYWMD | WVRQAPGKGLEWVS | GIYPSGGYTLYADSVKG | RFTISRDNSKNTLYLQMNSLRAEDTAVYYCAR | HGDYMDV | WGKGTTVTVSS |
| EVQLLESGGGLVQPGGSLRLSCAASGFTFS | TYPMS | WVRQAPGKGLEWVS | SISPSGGWTRYADSVKG | RFTISRDNSKNTLYLQMNSLRAEDTAVYYCAS | SPYGPDAFDI | WGQGTMVTVSS |
| EVQLLESGGGLVQPGGSLRLSCAASGFTFS | WYKMG | WVRQAPGKGLEWVS | GISSSGGLTFYADSVKG | RFTISRDNSNNTLYLQMNSLRAEDTAVYYCAR | VPAYSSGYGGFDY | WGQGTLVTVSS |
| EVQLLESGGGLVQPGGSLRLSCAASGFTFS | WYPMI | WVRQAPGKGLEWVS | SISSSGGYTHYADSVKG | RFTISRDNSKNTLYLQMNSLRAEDTAVYYCAR | EGVDTAMAFGY | WGQGTLVTVSS |
| EVQLLESGGGLVQPGGSLRLSCAASGFTFS | YYEME | WVRQAPGKGLEWVS | GIYPSGGITTYADSVKG | RFTISRDNSKNTLYLQMNSLRAEDTAVYYCAR | VFFYYDSSGYYAPYFDY | WGQGTLVTVSS |
| EVQLLESGGGLVQPGGSLRLSCAASGFTFS | YYPMA | WVRQAPGKGLEWVS | YISSSGGLTTYADSVKG | RFTISRDNSKNTLYLQMNSLRAEDTAVYYCAR | SPTYYDFWSGYWAGIFDY | WGQGTLVTVSS |
| EVQLLESGGGLVQPGGSLRLSCAASGFTFS | YYPMV | WVRQAPGKGLEWVS | VIYPSGGYTHYADSVKG | RFTISRDNSKNTLYLQMNSLRAEDTAMYYCAR | VGYDSSGYYWGYFDY | WGQGTLVTVSS |
| EVQLLESGGGLVQPGGSLRLSCAASGFTFV | YHMQ | WVRQAPGKGLEWVS | GISPSGGLTDYADSVKG | RFTISRDNSKNTLYLQMNSLRAEDTAVYYCAH | GTDPLTY | WGQGTLVTVSS |

2. MMP-12 Inhibitors-Light Chain Variable region

| Initial Name | LV-FR1 (SEQ ID NOS 2423-2434) | LV-CDR1 (SEQ ID NOS 2435-2446) | LV-FR2 (SEQ ID NOS 2447-2458) | LV-CDR2 (SEQ ID NOS 2459-2470) |
|---|---|---|---|---|
| 539BM0034-C04- | QDIQMTQSPSSLSASVGDRVSITC | RASQNINSYLN | WYQQKVGKAPKLLIF | GAYTLHS |
| 539B-M0039-F01 | QNIQMTQSPSSVSASVGDRVTITC | RASQDINYWLA | WYQQKPGKAPKLLIY | AASSLQS |
| 539B-M0041-B05 | QDIQMTQSPSSLSASVGDRVSITC | RASQNINSYLN | WYQQKVGKAPKLLIF | GAYTLHS |
| 539B-M0041-G01 | QDIQMTQSPSSLSASVGDRVTITC | RASQSISYFLN | WYQQKPGKAPKLLIY | AASTLQG |

-continued

| Initial Name | LV-FR1 | LV-CDR1 | LV-FR2 | LV-CDR2 |
|---|---|---|---|---|
| 539B-M0042-B06 | QDIQMTQSPDTLSLSPGERATLSC | RASQTISSTFLA | WYQQKPGQAPRLLIY | GASTRAA |
| 539B-M0006-B10 | QDIQMTQSPGTLSLSPGERATLSC | RASQSVSSSYLA | WYQQKPGQAPRLLIY | GASSRAT |
| 539B-M0007-H06 | QDIQMTQSPGTLSLSSGERATLSC | RASQSVSSNYLA | WYQQKRGQAPRLLIY | GASSRAT |
| 539B-M0008-H09 | QDIQMTQSPSSLSASVGDRVTITC | RANQSIYTYLN | WYQQKPGKAPELLIY | AASSLQS |
| 539B-M0009-H08 | QYELTQPPALSVAPGETATITC | GGDKIGRKSVN | WYQQKAGQAPVLVIF | YDNDRPS |
| 539B-M0011-H11 | QSALTQPPSVSVAPGQTARITC | GGNNIGTKSVH | WYQQKSGQAPVLVVY | DNSDRPS |
| 539B-M0015-F02 | QDIQMTQSPGTLSLSPGERATLSC | RASQSVSSSYLA | WYQQKPGQAPRLLIY | GASSRAT |
| 539B-M0016-D01 | QSELTQPPSVSVSPGQTATITC | SGDVSVHKSFC | WYQQRPGQSPVLVIY | QIDKRPS |

| Initial Name | LV-FR3 (SEQ ID NOS 2471-2482) | LV-CDR3 (SEQ ID NOS 2483-2494) | LV-FR4 (SEQ ID NOS 2495-2506) | L-Constant (SEQ ID NOS 2507-2518) |
|---|---|---|---|---|
| 539BM0034-C04- | GAPSRFSGSGSGTDFTLTISSLQPEDVATYYC | QQTYTSYS | FAQGTKLEIK | AAPSVFI |
| 539B-M0039-F01 | GVPSRFSGSGSGTDFTLTISSLQPEDFATYYC | QRANSFPYT | FGQGTKLEIK | RTVAAPS |
| 539B-M0041-B05 | GAPSRFSGSGSGTDFTLTISSLQPEDVATYYC | QQTYTSYS | FAQGTKLEIK | AAPSVFI |
| 539B-M0041-G01 | GVPSRFRGSGSGTDFTLTISSLQPEDFATYYC | QHSYSTPPIT | FGPGTKVDIK | RTVAAPS |
| 539B-M0042-B06 | GIPDRFIGSGSGTDFTLTISSLEPEDSAVYYC | QQYDRSPT | FGGGTKVEIK | RTVAAPS |
| 539B-M0006-B10 | GIPDRFSGSGSGTDFTLTISRLEPEDFAVYYC | QQYGSSPRT | FGQGTKLEIK | RTVAAPS |
| 539B-M0007-H06 | GVPGRFSGSGSGTDFTLTISRLEPEDFAVYYC | QQYGSSPRT | FGQGTKLEIK | RTVAAPS |
| 539B-M0008-H09 | GVPSRFSGSGSGTDFTLTISSLQPEDFATYYC | QQAGI | FGQGTKLEIK | RTVAAPS |
| 539B-M0009-H08 | GITGRFSGSNSGNSATLTISRVEAGDEADFYC | QVWGPNDFPL | FGGGTKLTVL | GQPKAAP |
| 539B-M0011-H11 | GIPERFSGSNSGNTATLTISRVEAGDEADYYC | QVWDNSIDHVV | FGGGTKLTVL | GQPKAAP |
| 539B-M0015-F02 | GIPDRFSGSGSGTDFTLTISRLEPEDFAVYYC | QQYGSSPPIT | FGQGTRLEIK | RTVAAPS |
| 539B-M0016-D01 | GVPERFSGSISGTTATLTISGTQATDEADYYC | QGWDSTTYYV | FGTGTKVTVL | SQPKANP |

1. MMP-12 Inhibitors Heavy Chain Variable Region Sequences (in the Same Order as the Light Chains Provided Above)

| HV-FR1 (SEQ ID NOS 2519-2531) | HV-CDR1 (SEQ ID NOS 2532-2544) | HV-FR2 (SEQ ID NOS 2545-2557) | HV-CDR2 (SEQ ID NOS 2558-2570) |
|---|---|---|---|
| EVQLLESGGGLVQPGGSLRLSCAASGFTFS | DYNMH | WVRQAPGKGLEWVS | YIGPSGGYTHYADSVKG |
| EVQLLESGGGLVQPGGSLRLSCAASGFTFS | EYPMY | WVRQAPGKGLEWVS | VIYPSGGWTDYADSVKG |
| EVQLLESGGGLVQPGGSLRLSCAASGFTFS | RYWMD | WVRQAPGKGLEWVS | GIYPSGGYTLYADSVKG |
| EVQLLESGGGLVQPGGSLRLSCAASGFTFS | EYPMY | WVRQAPGKGLEWVS | VIYPSGGWTDYADSVKG |
| EVQLLESGGGLVQPGGSLRLSCAASGFTFS | YYPMA | WVRQAPGKGLEWVS | YISSSGGLTTYADSVKG |
| EVQLLESGGGLVQPGGSLRLSCAASGFTFS | FYHME | WVRQAPGKGLEWVS | SISPSGGHTDYADSVKG |
| EVQLLESGGGLVQPGGSLRLSCAASGFTFS | SYGMH | WVRQAPGKGLEWVS | GIVSSGGSTIYADSVKG |
| EVQLLESGGGLVQPGGSLRLSCAASGFTFS | HYWMH | WVRQAPGKGLEWVS | SISSSGGMTYYADSVKG |
| EVQLLESGGGLVQPGGSLRLSCAASGFTFS | DYNMH | WVRQAPGKGLEWVS | YIGPSGGYTHYADSVKG |
| EVQLLESGGGLVQPGGSLRLSCAASGFTFS | MYWMF | WVRQAPGKGLEWVS | SISSSGGHTFYADSVKG |
| EVQLLESGGGLVQPGGSLRLSCAASGFTFS | WYNMW | WVRQAPGKGLEWVS | YIYPSGGNTGYADSVKG |

-continued

| | | |
|---|---|---|
| EVQLLESGGGLVQPGGSLRLSCAASGFTFS RYGMT | WVRQAPGKGLEWVS | GISPSGGNTWYADSVKG |
| EVQLLESGGGLVQPGGSLRLSCAASGFTFS EYNMP | WVRQAPGKGLEWVS | YIYSSGGSTEYADSVKG |

| HV-FR3 (SEQ ID NOS 2571-2583) | HV-CDR3 (SEQ ID NOS 2584-2596) | HV-FR4 (SEQ ID NOS 2597-2609) |
|---|---|---|
| RFTISRDNSKNTLYLQMNSLRAEDTAVYYCAK | DIRGAYSSGLFDY | WGRGTLVTVSS |
| RFTISRDNSKNTLYLQMNSLRAEDTAVYYCAR | MAVTGGSRFDY | WGQGTLVTVSS |
| RFTISRDNSKNTLYLQMNSLRAEDTAVYYCAR | HGDYMDV | WGKGTTVTVSS |
| RFTISRDNSKNTLYLQMNSLRAEDTAVYYCAR | MAVTGGSRFDY | WGQGTLVTVSS |
| RFTISRDNSKNTLYLQMNSLRAEDTAVYYCAR | SPTYYDFWSGYWAGIFDY | WGQGTLVTVSS |
| RFTISRDNSKNTLYLQMNSLRAEDTAVYYCAS | LLSGT | WGQGTLVTVSS |
| RFTISRDNSKNTLYLQMNSLRAEDTAVYYCTT | YDYGDHYGMDV | WGQGTTVTVSS |
| RFTISRDNSKNTLYLQMNSLRAEDTAVYYCTT | ADYGYYYGMDV | WGQGTTVTVSS |
| RFTISRDNSKNTLYLQMNSLRAEDTAVYYCAK | DIRGAYSSGLFDY | WGRGTLVTVSS |
| RFTISRDNSKNTLYLQMNSLRAEDTAVYYCAR | GSYSGYDPFDY | WGRGTLVTVSS |
| RFTISRDNSKNTLYLQMNSLRAEDTAVYYCAV | FEYSSSGPQGY | WGQGTLVTVSS |
| RFTISRDNSKNTLYLQMNSLRAEDTAVYYCTS | HDYGDHYGMDV | WGQGTLVTVSS |
| RFTISRDNSKNTLYLQMNSLRAEDMAVYYCAK | DLWEDSSTWGYGMDV | WGQGTTVTVSS |

2. MMP-12 Inhibitors Heavy Chain FR4 & Constant Region Sequences (in the Same Order as the Light Chains Provided Above)

| HV-FR4 | SEQ ID NO: |
|---|---|
| WGRGTLVTVSS | 2610 |
| WGQGTLVTVSS | 2611 |
| WGKGTTVTVSS | 2612 |
| WGQGTLVTVSS | 2613 |
| WGQGTLVTVSS | 2614 |
| WGQGTLVTVSS | 2615 |
| WGQGTTVTVSS | 2616 |
| WGQGTTVTVSS | 2617 |
| WGRGTLVTVSS | 2618 |
| WGRGTLVTVSS | 2619 |
| WGQGTLVTVSS | 2620 |
| WGQGTLVTVSS | 2621 |
| WGQGTTVTVSS | 2622 |

Example 6

Additional MMP-12 Binding Proteins

Twenty-one additional mutants were prepared:

Eighteen mutants of DX-2712 were made by changing residues in the CDR1 and 2 of the HC of DX-2712.

A residue in the light chain of each of DX-2712, M0121-E07, and M0008-H09 (the parental antibody) was glycosylated.

18 mutants of DX-2712:

| Clone: | Heavy/Light Chain Mutations HC Mutant 539B-X41-B01: LC is 539B-X40-A01 (S25) |
|---|---|
| 539B-X0041-A01 | W31D; M56Y; M58H |
| 539B-X0041-B01 | W31D; M56Y; M58H; V97R; P99A; A102S |
| 539B-X0041-C01 | V97R; P99A; A102S |
| 539B-X0041-E01 | P99A |
| 539B-X0041-F01 | A102S |
| 539B-X0041-A02 | M58H |
| 539B-X0041-B02 | V97R |
| 539B-X0041-C02 | M56Y |
| 539B-X0041-D02 | W31D |

| Clone: | Light chain Swap: LC is S25N |
|---|---|
| 539B-X0042-C01 | X0041-A01 |
| 539B-X0042-B02 | X0041-B01 |
| 539B-X0042-F03 | X0041-C01 |
| 539B-X0042-G04 = 539B-X0042-B04 | X0041-E01 |
| 539B-X0042-A05 | X0041-F01 |
| 539B-X0042-D06 | X0041-A02 |
| 539B-X0042-C07 | X0041-B02 |
| 539B-X0042-H08 | X0041-C02 |
| 539B-X0042-G09 | X0041-D02 |

LC S25N glycosylated variants of DX-2712, M008-H09, M0121-E07:

| Clone | Details |
|---|---|
| 539B-X0041-D01 | DX-2712 + sugar |
| 539B-X0041-G01 | Parental (M0008-H09) + sugar |
| 539B-X0041-H01 | Back-up (M0121-E07) + sugar |

18 mutants of DX-2712 plus 3 LC S25N glycosylated
variants of DX-2712, M008-H09, M0121-E07:

| Isolate | L-Leader (SEQ ID NOS 2623-2644) | LV-FR1 (SEQ ID NOS 2645-2666) | LV-CDR1 (SEQ ID NOS 2667-2688) | LV-FR2 (SEQ ID NOS 2689-2710) | LV-CDR2 (SEQ ID NOS 2711-2732) | LV-FR3 (SEQ ID NOS 2733-2754) | LV-CDR3 (SEQ ID NOS 2755-2776) | LV-FR4 (SEQ ID NOS 2777-2798) | L-Constant (SEQ ID NOS 2777-2812) |
|---|---|---|---|---|---|---|---|---|---|
| 539B-X0041-A01 | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC.. |
| 539B-X0041-A02 | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | |
| 539B-X0041-B01 | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | |
| 539B-X0041-B02 | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | |
| 539B-X0041-C01 | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | |
| 539B-X0041-C02 | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC.. |
| 539B-X0041-D01 | GVHS | DIQMTQSPSSLSASVGDRVTITC | RANQSIYTYLN | WYQQKPGKAPKLLIY | AASSLQS | GVPSRFSGSGSGTDFTLTISSLQPEDFATYYC | QQAGI | FGQGTKLEIK | |
| 539B-X0041-D02 | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC.. |
| 539B-X0041-E01 | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | |
| 539B-X0041-F01 | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | |
| 539B-X0041-G01 | GVHS | DIQMTQSPSSLSASVGDRVTITC | RANQSIYTYLN | WYQQKPGKAPKLLIY | AASSLQS | GVPSRFSGSGSGTDFTLTISSLQPEDFATYYC | QQAGI | FGQGTKLEIK | RTVAAPSVFIFPPSDEQLKSGTASVVCLLNNFYPREAKVQWKVDNALQSGNSQESVTEQDSKDSTYSLSS |

| | | | | | | | | | | |
|---|---|---|---|---|---|---|---|---|---|---|
| | | | | | | | | | | TLTLSKADYE KHKVYACEVT HQGLSSPVTK SFNRGEC.. |
| 539B-X0041-H01 | GVHS | DIQMTQSPSS LSASVGDRVT ITC | RANQSI YTYLN | WYQQKPG KAPKLLIY | AASS LQS | GVPSRFSGSGS QQAGI GTDFTLTISSL QPEDFATYYC | FGQGT KLEIK | |
| 539B-X0042-A05 | GVHS | DIQMTQSPSS LSASVGDRVT ITC | RANQSI YTYLN | WYQQKPG KAPKLLIY | AASS LQS | GVPSRFSGSGS QQAGI GTDFTLTISSL QPEDFATYYC | FGQGT KLEIK | RTVAAPS |
| 539B-X0042-B02 | GVHS | DIQMTQSPSS LSASVGDRVT ITC | RANQSI YTYLN | WYQQKPG KAPKLLIY | AASS LQS | GVPSRFSGSGS QQAGI GTDFTLTISSL QPEDFATYYC | FGQGT KLEIK | RTVAAPSVFI FPPSDEQLKS GTASVVCLLN NFYPREAKVQ WKVDNALQSG NSQESVTEQD SKDSzYSLSS TLTLSKADYE KHKVYACEVT HQGLSSPVTK SFNRGEC.. |
| 539B-X0042-B04 | GVHS | DIQMTQSPSS LSASVGDRVT ITC | RANQSI YTYLN | WYQQKPG KAPKLLIY | AASS LQS | GVPSRFSGSGS QQAGI GTDFTLTISSL QPEDFATYYC | FGQGT KLEIK | RTVAAPSVFI FPPSDEQLKS GTASVVCLLN NFYPREAKVQ WKVDNALQSG NSQESVTEQD SKDSzYSLSS TLTLSKADYE KHKVYACEVT HQGLSSPVTK SFNRGEC.. |
| 539B-X0042-C01 | GVHS | DIQMTQSPSS LSASVGDRVT ITC | RANQSI YTYLN | WYQQKPG KAPKLLIY | AASS LQS | GVPSRFSGSGS QQAGI GTDFTLTISSL QPEDFATYYC | FGQGT KLEIK | RTVAAPSVFI FPPSDEQLKS GTASVVCLLN NFYPREAKVQ WKVDNALQSG NSQESVTEQD SKDSzzYSLSS TLTLSKADYE KHKVYACEVT HQGLSSPVTK SFNRGEC.. |
| 539B-X0042-C07 | GVHS | DIQMTQSPSS LSASVGDRVT ITC | RANQSI YTYLN | WYQQKPG KAPKLLIY | AASS LQS | GVPSRFSGSGS QQAGI GTDFTLTISSL QPEDFATYYC | FGQGT KLEIK | RTVAAPSVFI FPPSDEQLKS GTASVVCLLN NFYPREAKVQ WKVDNALQSG NSQESVTEQD SKDSzLLPVQ HPDPVQGRLR EAQGVRLRGD PPGPVLPRDQ VLQPGRVLM |
| 539B-X0042-D06 | GVHS | DIQMTQSPSS LSASVGDRVT ITC | RANQSI YTYLN | WYQQKPG KAPKLLIY | AASS LQS | GVPSRFSGSGS QQAGI GTDFTLTISSL QPEDFATYYC | FGQGT KLEIK | RTVAAPSVFI FPPSDEQLKS GTASVVCLLN NFYPREAKVQ WKVDNALQSG NSQESVTEQD SKDSzYSLSS TLTLSKADYE KHKVYACEVT HQGLSSPVTK SFNRGEC.. |
| 539B-X0042-F03 | GVHS | DIQMTQSPSS LSASVGDRVT ITC | RANQSI YTYLN | WYQQKPG KAPKLLIY | AASS LQS | GVPSRFSGSGS QQAGI GTDFTLTISSL QPEDFATYYC | FGQGT KLEIK | RTVAAPSVFI FPPSDEQLKS GTASVVCLLN NFYPREAKVQ WKVDNALQSG NSQESVTEQD SKDSzzYSLSS |

-continued

| | | | | | | | | | | TLTLSKADYE KHKVYACEVT HQGLSSPVTK SFNRGEC.. |
|---|---|---|---|---|---|---|---|---|---|---|
| 539B-X0042-G04 | | GVHS | DIQMTQSPSS LSASVGDRVT ITC | RANQSI YTYLN | WYQQKPG KAPKLLIY | AASS LQS | GVPSRFSGSGS GTDFTLTISSL QPEDFATYYC | QQAGI | FGQGT KLEIK | RTVAAPSVFI FPPSDEQLKS GTASVVCLLN NFYPREAKVQ WKVDNALQSG NSQESVTEQD SKDzzYSLSS TLTLSKADYE KHKVYACEVT HQGLSSPVTK SFNRGEC.. |
| 539B-X0042-G09 | | GVHS | DIQMTQSPSS LSASVGDRVT ITC | RANQSI YTYLN | WYQQKPG KAPKLLIY | AASS LQS | GVPSRFSGSGS GTDFTLTISSL QPEDFATYYC | QQAGI | FGQGT KLEIK | RTVAAPSVFI FPPSDEQLKS GTASVVCLLN NFYPREAKVQ WKVDNALQSG NSQESVTEQD SKDzzYSLSS TLTLSKADYE KHKVYACEVT HQGLSSPVTK SFNRGEC.. |
| 539B-X0042-H08 | | GVHS | DIQMTQSPSS LSASVGDRVT ITC | RANQSI YTYLN | WYQQKPG KAPKLLIY | AASS LQS | GVPSRFSGSGS GTDFTLTISSL QPEDFATYYC | QQAGI | FGQGT KLEIK | RTVAAPS |

| 2988 Isolate | H-Leader (SEQ ID NOS 2813-2834) | HV-FR1 (SEQ ID NOS 2835-2856) | HV-CDR1 (SEQ ID NOS 2857-2878) | HV-FR2 (SEQ ID NOS 2879-2900) | HV-CDR2 (SEQ ID NOS 2901-2922) | HV-FR3 (SEQ ID NOS 2923-2944) | HV-CDR3 (SEQ ID NOS 2945-2966) | HV-FR4 (SEQ ID NOS 2967-2988) | H-Constant (SEQ ID NOS 2989-3010) |
|---|---|---|---|---|---|---|---|---|---|
| 539B-X0041-A01 | MGWSCIILFL VATATGAHS | EVQLLESGGG LVQPGGSLRL SCAASGFTFS | DYWMH | WVRQAPGK GLEWVS | GISPSGGYT HYADSVKG | RFTISRDNSKN TLYLQMNSLRA EDTAVYYCAR | DIVGPYSA GLFDY | WGRGTLVT VSS | ASTKGPSVFP LAPSSKS |
| 539B-X0041-A02 | MGWSCIILFL VATATGAHS | EVQLLESGGG LVQPGGSLRL SCAASGFTFS | WYWMH | WVRQAPGK GLEWVS | GISPSGGMT HYADSVKG | RFTISRDNSKN TLYLQMNSLRA EDTAVYYCAR | DIVGPYSA GLFDY | WGRGTLVT VSS | ASTKGPSVFP LAPSSKS |
| 539B-X0041-B01 | MGWSCIILFL VATATGAHS | EVQLLESGGG LVQPGGSLRL SCAASGFTFS | DYWMH | WVRQAPGK GLEWVS | GISPSGGYT HYADSVKG | RFTISRDNSKN TLYLQMNSLRA EDTAVYYCAR | DIRGAYSS GLFDY | WGRGTLVT VSS | ASTKGPSVFP LAPSSKS |
| 539B-X0041-B02 | MGWSCIILFL VATATGAHS | EVQLLESGGG LVQPGGSLRL SCAASGFTFS | WYWMH | WVRQAPGK GLEWVS | GISPSGGMT MYADSVKG | RFTISRDNSKN TLYLQMNSLRA EDTAVYYCAR | DIRGPYSA GLFDY | WGRGTLVT VSS | ASTKGPSVFP LAPSSKS |
| 539B-X0041-C01 | MGWSCIILFL VATATGAHS | EVQLLESGGG LVQPGGSLRL SCAASGFTFS | WYWMH | WVRQAPGK GLEWVS | GISPSGGMT MYADSVKG | RFTISRDNSKN TLYLQMNSLRA EDTAVYYCAR | DIRGAYSS GLFDY | WGRGTLVT VSS | ASTKGPSVFP LAPSSKS |
| 539B-X0041-C02 | MGWSCIILFL VATATGAHS | EVQLLESGGG LVQPGGSLRL SCAASGFTFS | WYWMH | WVRQAPGK GLEWVS | GISPSGGYT MYADSVKG | RFTISRDNSKN TLYLQMNSLRA EDTAVYYCAR | DIVGPYSA GLFDY | WGRGTLVT VSS | ASTKGPSVFP LAPSSKS |
| 539B-X0041-D01 | MGWSCIILFL VATATGAHS | EVQLLESGGG LVQPGGSLRL SCAASGFTFS | WYWMH | WVRQAPGK GLEWVS | GISPSGGMT MYADSVKG | RFTISRDNSKN TLYLQMNSLRA EDTAVYYCAR | DIVGPYSA GLFDY | WGRGTLVT VSS | ASTKGPSVFP LAPSSKS |
| 539B-X0041-D02 | MGWSCIILFL VATATGAHS | EVQLLESGGG LVQPGGSLRL SCAASGFTFS | DYWMH | WVRQAPGK GLEWVS | GISPSGGMT MYADSVKG | RFTISRDNSKN TLYLQMNSLRA EDTAVYYCAR | DIVGPYSA GLFDY | WGRGTLVT VSS | ASTKGPSVFP LAPSSKS |
| 539B-X0041-E01 | MGWSCIILFL VATATGAHS | EVQLLESGGG VQPGGSLRLS LCAASGFTFS | WYWMH | WVRQAPGK GLEWVS | GISPSGGMT MYADSVKG | RFTISRDNSKN TLYLQMNSLRA EDTAVYYCAR | DIVGAYSA GLFDY | WGRGTLVT VSS | ASTKGPSVFP LAPSSKS |
| 539B-X0041-F01 | MGWSCIILFL VATATGAHS | EVQLLESGGG LVQPGGSLRL SCAASGFTFS | WYWMH | WVRQAPGK GLEWVS | GISPSGGMT MYADSVKG | RFTISRDNSKN TLYLQMNSLRA EDTAVYYCAR | DIVGPYSS GLFDY | WGRGTLVT VSS | ASTKGPSVFP LAPSSKS |

| | | | | | | | |
|---|---|---|---|---|---|---|---|
| 539B-X0041-G01 | MGWSCIILFL VATATGAHS | EVQLLESGGG LVQPGGSLRL SCAASGFTFS | DYNMH | WVRQAPGK GLEWVS | YIGPSGGYT HYADSVKG | RFTISRDNSKN TLYLQMNSLRA EDTAVYYCAK | WGRGTLVT VSS | ASTKGPSVFP LAPSSKS |
| 539B-X0041-H01 | MGWSCIILFL VATATGAHS | EVQLLESGGG LVQPGGSLRL SCAASGFTFS | WYGMH | WVRQAPGK GLEWVS | GIVSSGGET FYADSVKG | RFTISRDNSKN TLYLQMNSLRA EDTAVYYCAK | WGRGTLVT VSS | ASTKGPSVFP LAPSSKS |
| 539B-X0042-A05 | MGWSCIILFL VATATGAHS | EVQLLESGGG LVQPGGSLRL SCAASGFTFS | WYWMH | WVRQAPGK GLEWVS | GISPSGGMT MYADSVKG | RFTISRDNSKN DIVGPYSS TLYLQMNSLRA EDTAVYYCAR | WGRGTLVT VSS | ASTKGPSVFP LAPSLQV |
| 539B-X0042-B02 | MGWSCIILFL VATATGAHS | EVQLLESGGG LVQPGGSLRL SCAASGFTFS | DYWMH | WVRQAPGK GLEWVS | GISPSGGYT HYADSVKG | RFTISRDNSKN DIRGAYSS TLYLQMNSLRA EDTAVYYCAR | WGRGTLVT VSS | ASTKGPSVFP LAPSSKS |
| 539B-X0042-B04 | MGWSCIILFL VATATGAHS | EVQLLESGGG LVQPGGSLRL SCAASGFTFS | WYWMH | WVRQAPGK GLEWVS | GISPSGGMT MYADSVKG | RFTISRDNSKN DIVGAYSA TLYLQMNSLRA EDTAVYYCAR | WGRGTLVT VSS | ASTKGPSVFP LAPSSKS |
| 539B-X0042-C01 | MGWSCIILFL VATATGAHS | EVQLLESGGG LVQPGGSLRL SCAASGFTFS | DYWMH | WVRQAPGK GLEWVS | GISPSGGYT HYADSVKG | RFTISRDNSKN DIVGPYSA TLYLQMNSLRA EDTAVYYCAR | WGRGTLVT VSS | ASTKGPSVFP LAPSSKS |
| 539B-X0042-C07 | MGWSCIILFL VATATGAHS | EVQLLESGGG LVQPGGSLRL SCAASGFTFS | WYWMH | WVRQAPGK GLEWVS | GISPSGGMT MYADSVKG | RFTISRDNSKN DIRGPYSA TLYLQMNSLRA EDTAVYYCAR | WGRGTLVT VSS | ASTKGPSVFP LAPSSKS |
| 539B-X0042-D06 | MGWSCIILFL VATATGAHS | EVQLLESGGG LVQPGGSLRL SCAASGFTFS | WYWMH | WVRQAPGK GLEWVS | GISPSGGMT MYADSVKG | RFTISRDNSKN DIVGPYSA TLYLQMNSLRA EDTAVYYCAR | WGRGTLVT VSS | ASTKGPSVFP LAPSSKS |
| 539B-X0042-F03 | MGWSCIILFL VATATGAHS | EVQLLESGGG LVQPGGSLRL SCAASGFTFS | WYWMH | WVRQAPGK GLEWVS | GISPSGGMT MYADSVKG | RFTISRDNSKN DIRGAYSS TLYLQMNSLRA EDTAVYYCAR | WGRGTLVT VSS | ASTKGPSVFP LAPSSKS |
| 539B-X0042-G04 | MGWSCIILFL VATATGAHS | EVQLLESGGG LVQPGGSLRL SCAASGFTFS | WYWMH | WVRQAPGK GLEWVS | GISPSGGMT MYADSVKG | RFTISRDNSKN DIVGAYSA TLYLQMNSLRA EDTAVYYCAR | WGRGTLVT VSS | ASTKGPSVFP LAPSSKS |
| 539B-X0042-G09 | MGWSCIILFL VATATGAHS | EVQLLESGGG LVQPGGSLRL SCAASGFTFS | DYWMH | WVRQAPGK GLEWVS | GISPSGGMT MYADSVKG | RFTISRDNSKN DIVGPYSA TLYLQMNSLRA EDTAVYYCAR | WGRGTLVT VSS | ASTKGPSVFP LAPSSKS |
| 539B-X0042-H08 | MGWSCIILFL VATATGAHS | EVQLLESGGG LVQPGGSLRL SCAASGFTFS | WYWMH | WVRQAPGK GLEWVS | GISPSGGYT MYADSVKG | RFTISRDWNSK NTLYLQMNSLR AEDTAVYYCAR | DIVGPYSA WGRGTLVT VSS | ASTKGPSVFP LAPSSKS |

| Isolate | LV-AA (SEQ ID NOS 3011-3032) | HV-AA (SEQ ID NOS 3033-3054) |
|---|---|---|
| 539B-X0041-A01 | DIQMTQSPSSLSASVGDRVTITCRASQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSDYWMHWVRQAPGKGLE WVSGISPSGGYTHYADSVKGRFTISRDNSKNTLYLQMNSLRAEDTA VYYCARDIVGPYSAGLFDYWGRGTLVTVSS |
| 539B-X0041-A02 | DIQMTQSPSSLSASVGDRVTITCRASQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSWYWMHWVRQAPGKGLE WVSGISPSGGMTHYADSVKGRFTISRDNSKNTLYLQMNSLRAEDTA VYYCARDIVGPYSAGLFDYWGRGTLVTVSS |
| 539B-X0041-B01 | DIQMTQSPSSLSASVGDRVTITCRASQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSDYWMHWVRQAPGKGLE WVSGISPSGGYTHYADSVKGRFTISRDNSKNTLYLQMNSLRAEDTA VYYCARDIRGAYSSGLFDYWGRGTLVTVSS |
| 539B-X0041-B02 | DIQMTQSPSSLSASVGDRVTITCRASQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSWYWMHWVRQAPGKGLE WVSGISPSGGMTYADSVKGRFTISRDNSKNTLYLQMNSLRAEDTA VYYCARDIRGPYSAGLFDYWGRGTLVTVSS |
| 539B-X0041-C01 | DIQMTQSPSSLSASVGDRVTITCRASQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSWYWMHWVRQAPGKGLE WVSGISPSGGMTYADSVKGRFTISRDNSKNTLYLQMNSLRAEDTA VYYCARDIRGAYSSGLFDYWGRGTLVTVSS |
| 539B-X0041-C02 | DIQMTQSPSSLSASVGDRVTITCRASQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSWYWMHWVRQAPGKGLE WVSGISPSGGYTMYADSVKGRFTISRDNSKNTLYLQMNSLRAEDTA VYYCARDIVGPYSAGLFDYWGRGTLVTVSS |
| 539B-X0041-D01 | DIQMTQSPSSLSASVGDRVTITCRANQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSWYWMHWVRQAPGKGLE WVSGISPSGGMTYADSVKGRFTISRDNSKNTLYLQMNSLRAEDTA VYYCARDIVGPYSAGLFDYWGRGTLVTVSS |

| | | |
|---|---|---|
| 539B-X0041-D02 | DIQMTQSPSSLSASVGDRVTITCRASQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSDYWMHWVRQAPGKGLE WVSGISPSGGMTMYADSVKGRFTISRDNSKNTLYLQMNSLRAEDTA VYYCARDIVGPYSAGLFDYWGRGTLVTVSS |
| 539B-X0041-E01 | DIQMTQSPSSLSASVGDRVTITCRASQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSWYWMHWVRQAPGKGLE WVSGISPSGGMTMYADSVKGRFTISRDNSKNTLYLQMNSLRAEDTA VYYCARDIVGAYSAGLFDYWGRGTLVTVSS |
| 539B-X0041-F01 | DIQMTQSPSSLSASVGDRVTITCRASQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSWYWMHWVRQAPGKGLE WVSGISPSGGMTMYADSVKGRFTISRDNSKNTLYLQMNSLRAEDTA VYYCARDIVGPYSSGLFDYWGRGTLVTVSS |
| 539B-X0041-G01 | DIQMTQSPSSLSASVGDRVTITCRANQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSDYNMHWVRQAPGKGLE WVSYIGPSGGYTHYADSVKGRFTISRDNSKNTLYLQMNSLRAEDTA VYYCAKDIRGAYSSGLFDYWGRGTLVTVSS |
| 539B-X0041-H01 | DIQMTQSPSSLSASVGDRVTITCRANQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSWYGMHWVRQAPGKGLE WVSGIVSSGGETFYADSVKGRFTISRDNSKNTLYLQMNSLRAEDTA VYYCAKDIRGVFLSGLFDHWGRGTLVTVSS |
| 539B-X0042-A05 | DIQMTQSPSSLSASVGDRVTITCRANQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSWYWMHWVRQAPGKGLE WVSGISPSGGMTMYADSVKGRFTISRDNSKNTLYLQMNSLRAEDTA VYYCARDIVGPYSSGLFDYWGRGTLVTVSS |
| 539B-X0042-B02 | DIQMTQSPSSLSASVGDRVTITCRANQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSDYWMHWVRQAPGKGLE WVSGISPSGGYTHYADSVKGRFTISRDNSKNTLYLQMNSLRAEDTA VYYCARDIRGAYSSGLFDYWGRGTLVTVSS |
| 539B-X0042-B04 | DIQMTQSPSSLSASVGDRVTITCRANQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSWYWMHWVRQAPGKGLE WVSGISPSGGMTMYADSVKGRFTISRDNSKNTLYLQMNSLRAEDTA VYYCARDIVGAYSAGLFDYWGRGTLVTVSS |
| 539B-X0042-C01 | DIQMTQSPSSLSASVGDRVTITCRANQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSDYWMHWVRQAPGKGLE WVSGISPSGGYTHYADSVKGRFTISRDNSKNTLYLQMNSLRAEDTA VYYCARDIVGPYSAGLFDYWGRGTLVTVSS |
| 539B-X0042-C07 | DIQMTQSPSSLSASVGDRVTITCRANQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSWYWMHWVRQAPGKGLE WVSGISPSGGMTMYADSVKGRFTISRDNSKNTLYLQMNSLRAEDTA VYYCARDIRGPYSAGLFDYWGRGTLVTVSS |
| 539B-X0042-D06 | DIQMTQSPSSLSASVGDRVTITCRANQSIYTYLN WYQQKPGKAPKLLIYAASSLQSGVPSRFSGSGSG ETDFTLTISSLQPEDFATYYCQQAGIFGQGTKLIK | EVQLLESGGGLVQPGGSLRLSCAASGFTFSWYWMHWVRQAPGKGLE WVSGISPSGGMTMYADSVKGRFTISRDNSKNTLYLQMNSLRAEDTA VYYCARDIVGPYSAGLFDYWGRGTLVTVSS |
| 539B-X0042-F03 | DIQMTQSPSSLSASVGDRVTITCRANQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSWYWMHWVRQAPGKGLE WVSGISPSGGMTMYADSVKGRFTISRDNSKNTLYLQMNSLRAEDTA VYYCARDIRGAYSSGLFDYWGRGTLVTVSS |
| 539B-X0042-G04 | DIQMTQSPSSLSASVGDRVTITCRANQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSWYWMHWVRQAPGKGLE WVSGISPSGGMTMYADSVKGRFTISRDNSKNTLYLQMNSLRAEDTA VYYCARDIVGAYSAGLFDYWGRGTLVTVSS |
| 539B-X0042-G09 | DIQMTQSPSSLSASVGDRVTITCRANQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSDYWMHWVRQAPGKGLE WVSGISPSGGMTMYADSVKGRFTISRDNSKNTLYLQMNSLRAEDTA VYYCARDIVGPYSAGLFDYWGRGTLVTVSS |
| 539B-X0042-H08 | DIQMTQSPSSLSASVGDRVTITCRANQSIYTYLN WYQQKPGKAPKLLIYAASSLQSGVPSRFSGSGSG TDFTLTISSLQPEDFATYYCQQAGIFGQGTKLEIK | EVQLLESGGGLVQPGGSLRLSCAASGFTFSWYWMHWVRQAPGKGLE SWVSGISPGGYTMYADSVKGRFTISRDNSKNTLYLQMNSLRAEDTA VYYCARDIVGPYSAGLFDYWGRGTLVTVSS |

Further, 13 variants on 539B-X0041-D02 were prepared.
539B-X0041-D02 plus 13 mutants of 539B-X0041-D02:

| Isolate | Initial Name | L-Leader (SEQ ID NOS 3055-3068) | LV-FR1 (SEQ ID NOS 3069-3082) | LV-CDR1 (SEQ ID NOS 3083-3096) | LV-FR2 (SEQ ID NOS 3097-3110) | LV-CDR2 (SEQ ID NOS 3111-3124) | LV-FR3 (SEQ ID NOS 3125-3138) | LV-CDR3 (SEQ ID NOS 3139-3152) | LV-FR4 (SEQ ID NOS 3153-3166) | L-Constant (SEQ ID NOS 3167-3180) |
|---|---|---|---|---|---|---|---|---|---|---|
| 539B-X0041-D02 | 539B-X0041-D02 | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC.. |
| 539B-X0049-A01 | X49-A01-M at H34 (germ-line)-LEU (L) | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC.. |
| 539B-X0049-B01 | X49-B01-M at H34 (germ-line)-THR (T) | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC.. |
| 539B-X0049-C01 | X49-C01-M at H56-SER (S) | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC.. |
| 539B-X0049-D01 | X49-D01-M at H58-TYR (Y) | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC.. |
| 539B-X0049-E01 | X49-E01-M at H56, H58-SER, TYR (S, Y) | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC.. |
| 539B-X0049-F01 | X49-F01-M at H34, H56, H58-LEU, SER, TYR (L, S, Y) | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC.. |
| 539B-X0049-G01 | X49-G01-P at H52a-GLY (G) | GVHS | DIQMTQSPSSLSASVGDRVTITC | RASQSIYTYLN | WYQQKPGKAPKLLIY | AASSLQS | GVPSRFSGSGSGTDFTLTISSLQPEDFATYYC | QQAGI | FGQGTKLEIK | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC.. |
| 539B-X0049-H01 | X49-H01-P at H52a | GVHS | DIQMTQSPSSLSASVGDR | RASQSIYTYLN | WYQQKPGKAPKLLIY | | GVPSRFSGSGSGTDFTLTISS | | | RTVAAPSVFIFPPSDEQLKSGTASVVCLLNNFYPREAKVQWKVDNALQ |

-continued

| Isolate | Initial Name | | L-FR1 | L-CDR1 | L-FR2 | L-CDR2 | L-FR3 | L-CDR3 | L-FR4 | L-Constant |
|---|---|---|---|---|---|---|---|---|---|---|
| | M at H34 (germline)-LEU (L) | | VTITC | | | | LQPEDFA TYYC | | | SGNSQESVTEQDSKDS TYSLSSTLTLSKADYE KHKVYACEVTHQGLSS PVTKSFNRGEC.. |
| 539B-X0049-A02 | X49-A02-P at H52a M at H34 (germline)-THR (T) | GVHS | DIQMTQ SPSSLS ASVGDR VTITC | RASQSIY TYLN | WYQQKP GKAPKL LIY | AASSLQS | GVPSRFS GSGSGTD FTLTISS LQPEDFA TYYC | QQAGI | FGQGTK LEIK | RTVAAPSVFIFPPSDE QLKSGTASVVCLLNNF YPREAKVQWKVDNALQ SGNSQESVTEQDSKDS TYSLSSTLTLSKADYE KHKVYACEVTHQGLSS PVTKSFNRGEC.. |
| 539B-X0049-B02 | X49-B02-P at H52a M at H56-SER (S) | GVHS | DIQMTQ SPSSLS ASVGDR VTITC | RASQSIY TYLN | WYQQKP GKAPKL LIY | AASSLQS | GVPSRFS GSGSGTD FTLTISS LQPEDFA TYYC | QQAGI | FGQGTK LEIK | RTVAAPSVFIFPPSDE QLKSGTASVVCLLNNF YPREAKVQWKVDNALQ SGNSQESVTEQDSKDS TYSLSSTLTLSKADYE KHKVYACEVTHQGLSS PVTKSFNRGEC.. |
| 539B-X0049-C02 | X49-C02-P at H52a M at H58-TYR (Y) | GVHS | DIQMTQ SPSSLS ASVGDR VTITC | RASQSIY TYLN | WYQQKP GKAPKL LIY | AASSLQS | GVPSRFS GSGSGTD FTLTISS LQPEDFA TYYC | QQAGI | FGQGTK LEIK | RTVAAPSVFIFPPSDE QLKSGTASVVCLLNNF YPREAKVQWKVDNALQ SGNSQESVTEQDSKDS TYSLSSTLTLSKADYE KHKVYACEVTHQGLSS PVTKSFNRGEC.. |
| 539B-X0049-D02 | X49-D02-P at H52a M at H56, H58-SER, TYR (S, Y) | GVHS | DIQMTQ SPSSLS ASVGDR VTITC | RASQSIY TYLN | WYQQKP GKAPKL LIY | AASSLQS | GVPSRFS GSGSGTD FTLTISS LQPEDFA TYYC | QQAGI | FGQGTK LEIK | RTVAAPSVFIFPPSDE QLKSGTASVVCLLNNF YPREAKVQWKVDNALQ SGNSQESVTEQDSKDS TYSLSSTLTLSKADYE KHKVYACEVTHQGLSS PVTKSENRGEC.. |
| 539B-X0049-E02 | X49-E02-P at H52a M at H34, H56, H58-LEU, SER, TYR (L, S, Y) | GVHS | DIQMTQ SPSSLS ASVGDR VTITC | RASQSIY TYLN | WYQQKP GKAPKL LIY | AASSLQS | GVPSRFS GSGSGTD FTLTISS LQPEDFA TYYC | QQAGI | FGQGTK LEIK | RTVAAPSVFIFPPSDE QLKSGTASVVCLLNNF YPREAKVQWKVDNALQ SGNSQESVTEQDSKDS TYSLSSTLTLSKADYE KHKVYACEVTHQGLSS PVTKSFNRGEC.. |

| Isolate | Initial Name | H-Leader (SEQ ID NOS 3181-3194) | HV-FR1 (SEQ ID NOS 3195-3208) | HV-CDR1 (SEQ ID NOS 3209-3222) | HV-FR2 (SEQ ID NOS 3223-3236) | HV-CDR2 (SEQ ID NOS 3237-3250) | HV-FR3 (SEQ ID NOS 3251-3264) | HV-CDR3 (SEQ ID NOS 3265-3278) | HV-FR4 (SEQ ID NOS 3279-3292) | H-Constant (SEQ ID NOS 3293-3306) |
|---|---|---|---|---|---|---|---|---|---|---|
| 539B-X0041-D02 | 539B-X0041-D02 | MGWSCIIL FLVATATG AHS | EVQLLES GGGLVQP GGSLRLS CAASGFT FS | DYWMH | WVRQAPG KGLEWVS | GISPSGG MTMYADS VKG | RFTISRDNSK NTLYLQMNSL RAEDTAVYYC AR | DIVGPYS AGLFDY | WGRGTL VTVSS | ASTKGPSV FPLAPSSK S |
| 539B-X0049-A01 | X49-A01-M at H34(germline)-LEU (L) | MGWSCIIL FLVATATG AHS | EVQLLES GGGLVQP GGSLRLS CAASGFT FS | DYWLH | WVRQAPG KGLEWVS | GISPSGG MTMYADS VKG | RFTISRDNSK NTLYLQMNSL RAEDTAVYYC AR | DIVGPYS AGLFDY | WGRGTL VTVSS | ASTKGPSV FPLAPSSK S |
| 539B-X0049-B01 | X49-B01-M at H34(germline)-THR (T) | MGWSCIIL FLVATATG AHS | EVQLLES GGGLVQP GRGSLLS CAASGFT FS | DYWTH | WVRQAPG KGLEWVS | GISPSGG MTMYADS VKG | RFTISRDNSK NTLYLQMNSL RAEDTAVYYC AR | DIVGPYS AGLFDY | WGRGTL VTVSS | ASTKGPSV FPLAPSSK S |
| 539B-X0049-C01 | X49-C01-M at H56- | MGWSCIIL FLVATATG | EVQLLES GGGLVQP | DYWMH | WVRQAPG KGLEWVS | GISPSGG STMYADS | RFTISRDNSK NTLYLQMNSL | DIVGPYS AGLFDY | WGRGTL VTVSS | ASTKGPSV FPLAPSSK |

-continued

| | | | | | | | | | | |
|---|---|---|---|---|---|---|---|---|---|---|
| C01 | SER (S) | | AHS | GGSLRLS CAASGFT FS | | | VKG | RAEDTAVYYC AR | | S |
| 539B-X0049-D01 | X49-D01-M at H58-TYR (Y) | MGWSCIIL FLVATATG AHS | EVQLLES GGGLVQP GGSLRLS CAASGFT FS | DYWMH | WVRQAPG KGLEWVS | GISPSGG MTYYADS VKG | RFTISRDNSK NTLYLQMNSL RAEDTAVYYC AR | DIVGPYS AGLFDY | WGRGTL VTVSS | ASTKGPSV FPLAPSSK S |
| 539B-X0049-E01 | X49-E01-M at H56, H58-SER, TYR (S, Y) | MGWSCIIL FLVATATG AHS | EVQLLES GGGLVQP GGSLRLS CAASGFT FS | DYWMH | WVRQAPG KGLEWVS | GISPSGG STYYADS VKG | RFTISRDNSK NTLYLQMNSL RAEDTAVYYC AR | DIVGPYS AGLFDY | WGRGTL VTVSS | ASTKGPSV FPLAPSSK S |
| 539B-X0049-F01 | X49-F01-M at H34, H56, H58-LEU, SER, TYR (L, S, Y) | MGWSCIIL FLVATATG AHS | EVQLLES GGGLVQP GGSLRLS CAASGFT FS | DYWLH | WVRQAPG KGLEWVS | GISPSGG STYYADS VKG | RFTISRDNSK NTLYLQMNSL RAEDTAVYYC AR | DIVGPYS AGLFDY | WGRGTL VTVSS | ASTKGPSV FPLAPSSK S |
| 539B-X0049-G01 | X49-G01-P at H52a-GLY (G) | MGWSCIIL FLVATATG AHS | EVQLLES GGGLVQP GGSLRLS CAASGFT FS | DYWMH | WVRQAPG KGLEWVS | GISGSGG MTMYADS VKG | RFTISRDNSK NTLYLQMNSL RAEDTAVYYC AR | DIVGPYS AGLFDY | WGRGTL VTVSS | ASTKGPSV FPLAPSSK S |
| 539B-X0049-H01 | X49-H01-P at H52a M at H34(germ-line)-LEU (L) | MGWSCIIL FLVATATG AHS | EVQLLES GGGLVQP GGSLRLS CAASGFT FS | DYWML | WVRQAPG KGLEWVS | GISGSGG MTMYADS VKG | RFTISRDNSK NTLYLQMNSL RAEDTAVYYC AR | DIVGPYS AGLFDY | WGRGTL VTVSS | ASTKGPSV FPLAPSSK S |
| 539B-X0049-A02 | X49-A02-P at H52a M at H34(germ-line)-THR (T) | MGWSCIIL FLVATATG AHS | EVQLLES GGGLVQP GGSLRLS CAASGFT FS | DYWTH | WVRQAPG KGLEWVS | GISGSGG MTMYADS VKG | RFTISRDNSK NTLYLQMNSL RAEDTAVYYC AR | DIVGPYS AGLFDY | WGRGTL VTVSS | ASTKGPSV FPLAPSSK S |
| 539B-X0049-B02 | X49-B02-P at H52a M at H56-SER (S) | MGWSCIIL FLVATATG AHS | EVQLLES GGGLVQP GGSLRLS CAASGFT FS | DYWMH | WVRQAPG KGLEWVS | GISGSGG STYYADS VKG | RFTISRDNSK NTLYLQMNSL RAEDTAVYYC AR | DIVGPYS AGLFDY | WGRGTL VTVSS | ASTKGPSV FPLAPSSK S |
| 539B-X0049-C02 | X49-C02-P at H52a M at H58-TYR (Y) | MGWSCIIL FLVATATG AHS | EVQLLES GGGLVQP GGSLRLS CAASGFT FS | DYWMH | WVRQAPG KGLEWVS | GISGSGG STYYADS VKG | RFTISRDNSK NTLYLQMNSL RAEDTAVYYC AR | DIVGPYS AGLFDY | WGRGTL VTVSS | ASTKGPSV FPLAPSSK S |
| 539B-X0049-D02 | X49-D02-P at H52a M at H56, H58-SER, TYR (S, Y) | MGWSCIIL FLVATATG AHS | EVQLLES GGGLVQP GGSLRLS CAASGFT FS | DYWMH | WVRQAPG KGLEWVS | GISGSGG STYYADS VKG | RFTISRDNSK NTLYLQMNSL RAEDTAVYYC AR | DIVGPYS AGLFDY | WGRGTL VTVSS | ASTKGPSV FPLAPSSK S |
| 539B-X0049-E02 | X49-E02-P at H52a M at H34, H56, H58-LEU, SER, TYR (L, S, Y) | MGWSCIIL FLVATATG AHS | EVQLLES GGGLVQP GGSLRLS CAASGFT FS | DYWLH | WVRQAPG KGLEWVS | GISGSGG STYYADS VKG | RFTISRDNSK NTLYLQMNSL RAEDTAVYYC AR | DIVGPYS AGLFDY | WGRGTL VTVSS | ASTKGPSV FPLAPSSK S |

| Isolate | Initial Name | LV-AA (SEQ ID NOS 3307-3320) | HV-AA (SEQ ID NOS 3321-3334) |
|---|---|---|---|
| 539B-X0041-D02 | 539B-X0041-D02 | DIQMTQSPSSLSASVGDRVTITCRASQSIYTYLNW YQQKPGKAPKLLIYAASSLQSGVPSRFSGSGSGTD FTLTISSLQPEDFATYYCQQAGIFGQGTKLEIK | EVQLLESGGGLVQPGGSLRLSCAASGFTFSDYWMH WVRQAPGKGLEWVSGISPSGGMTYYADSVKGRFTI SRDNSKNTLYLQMNSLRAEDTAVYYCARDIVGPYS |
| 539B-X0049-A01 | X49-A01-M at H34 (germ- | DIQMTQSPSSLSASVGDRVTITCRASQSIYTYLNW YQQKPGKAPKLLIYAASSLQSGVPSRFSGSGSGTD FTLTISSLQPEDFATYYCQQAGIFGQGTKLEIK | AGLFDYWGRGTLVTVSSEVQLLESGGGLVQPGGSL RLSCAASGFTFSDYWLHWVRQAPGKGLEWVSGISP SGGMTMYADSVKGRFTISRDNSKNTLYLQMNSLRA |

| | | | |
|---|---|---|---|
| | line)-<br>LEU (L) | | EDTAVYYCARDIVGPYSAGLFDYWGRGTLVTVSS |
| 539B-<br>X0049-<br>B01 | X49-B01-M<br>at H34<br>(germ-<br>line)-<br>THR (T) | DIQMTQSPSSLSASVGDRVTITCRASQSIYTYLNW<br>YQQKPGKAPKLLIYAASSLQSGVPSRFSGSGSGTD<br>FTLTISSLQPEDFATYYCQQAGIFGQGTKLEIK | EVQLLESGGGLVQPGGSLRLSCAASGFTFSDYWTH<br>WVRQAPGKGLEWVSGISPSGGMTMYADSVKGRFTI<br>SRDNSKNTLYLQMNSLRAEDTAVYYCARDIVGPYS<br>AGLFDYWGRGTLVTVSS |
| 539B-<br>X0049-<br>C01 | X49-C01-M<br>at H56-<br>SER (S) | DIQMTQSPSSLSASVGDRVTITCRASQSIYTYLNW<br>YQQKPGKAPKLLIYAASSLQSGVPSRFSGSGSGTD<br>FTLTISSLQPEDFATYYCQQAGIFGQGTKLEIK | EVQLLESGGGLVQPGGSLRLSCAASGFTFSDYWMH<br>WVRQAPGKGLEWVSGISPSGGSTMYADSVKGRFTI<br>SRDNSKNTLYLQMNSLRAEDTAVYYCARDIVGPYS<br>AGLFDYWGRGTLVTVSS |
| 539B-<br>X0049-<br>D01 | X49-D01-M<br>at H58-<br>TYR (Y) | DIQMTQSPSSLSASVGDRVTITCRASQSIYTYLNW<br>YQQKPGKAPKLLIYAASSLQSGVPSRFSGSGSGTD<br>FTLTISSLQPEDFATYYCQQAGIFGQGTKLEIK | EVQLLESGGGLVQPGGSLRLSCAASGFTFSDYWMH<br>WVRQAPGKGLEWVSGISPSGGMTYADSVKGRFTI<br>SRDNSKNTLYLQMNSLRAEDTAVYYCARDIVGPYS<br>AGLFDYWGRGTLVTVSS |
| 539B-<br>X0049-<br>E01 | X49-E01-M<br>at H56,<br>H58-SER,<br>TYR<br>(S, Y) | DIQMTQSPSSLSASVGDRVTITCRASQSIYTYLNW<br>YQQKPGKAPKLLIYAASSLQSGVPSRFSGSGSGTD<br>FTLTISSLQPEDFATYYCQQAGIFGQGTKLEIK | EVQLLESGGGLVQPGGSLRLSCAASGFTFSDYWMH<br>WVRQAPGKGLEWVSGISPSGGSTYYADSVKGRFTI<br>SRDNSKNTLYLQMNSLRAEDTAVYYCARDIVGPYS<br>AGLFDYWGRGTLVTVSS |
| 539B-<br>X0049-<br>F01 | X49-F01-M<br>at H34,<br>H56,<br>H58-LEU,<br>SER, TYR<br>(L, S, Y) | DIQMTQSPSSLSASVGDRVTITCRASQSIYTYLNW<br>YQQKPGKAPKLLIYAASSLQSGVPSRFSGSGSGTD<br>FTLTISSLQPEDFATYYCQQAGIFGQGTKLEIK | EVQLLESGGGLVQPGGSLRLSCAASGFTFSDYWLH<br>WVRQAPGKGLEWVSGISPSGGSTYYADSVKGRFTI<br>SRDNSKNTLYLQMNSLRAEDTAVYYCARDIVGPYS<br>AGLFDYWGRGTLVTVSS |
| 539B-<br>X0049-<br>G01 | X49-G01-P<br>at H52a-<br>GLY (G) | DIQMTQSPSSLSASVGDRVTITCRASQSIYTYLNW<br>YQQKPGKAPKLLIYAASSLQSGVPSRFSGSGSGTD<br>FTLTISSLQPEDFATYYCQQAGIFGOGTKLEIK | EVQLLESGGGLVQPGGSLRLSCAASGFTFSDYWMH<br>WVRQAPGKGLEWVSGISGSGGMTMYADSVKGRFTI<br>SRDNSKNTLYLQMNSLRAEDTAVYYCARDIVGPYS<br>AGLFDYWGRGTLVTVSS |
| 539B-<br>X0049-<br>H01 | X49-H01-P<br>at H52a M<br>at H34<br>(germ-<br>line)-<br>LEU (L) | DIQMTQSPSSLSASVGDRVTITCRASQSIYTYLNW<br>YQQKPGKAPKLLIYAASSLQSGVPSRFSGSGSGTD<br>FTLTISSLQPEDFATYYCQQAGIFGQGTKLEIK | EVQLLESGGGLVQPGGSLRLSCAASGFTFSDYWLH<br>WVRQAPGKGLEWVSGISGSGGMTMYADSVKGRFTI<br>SRDNSKNTLYLQMNSLRAEDTAVYYCARDIVGPYS<br>AGLFDYWGRGTLVTVSS |
| 539B-<br>X0049-<br>A02 | X49-A02-P<br>at H52a M<br>at H34<br>(germ-<br>line)-<br>THR (T) | DIQMTQSPSSLSASVGDRVTITCRASQSIYTYLNW<br>YQQKPGKAPKLLIYAASSLQSGVPSRFSGSGSGTD<br>FTLTISSLQPEDFATYYCQQAGIFGQGTKLEIK | EVQLLESGGGLVQPGGSLRLSCAASGFTFSDYWTH<br>WVRQAPGKGLEWVSGISGSGGMTMYADSVKGRFTI<br>SRDNSKNTLYLQMNSLRAEDTAVYYCARDIVGPYS<br>AGLFDYWGRGTLVTVSS |
| 539B-<br>X0049-<br>B02 | X49-B02-P<br>at H52a M<br>at H56-SER<br>(S) | DIQMTQSPSSLSASVGDRVTITCRASQSIYTYLNW<br>YQQKPGKAPKLLIYAASSLQSGVPSRFSGSGSGTD<br>FTLTISSLQPEDFATYYCQQAGIFGQGTKLEIK | EVQLLESGGGLVQPGGSLRLSCAASGFTFSDYWMH<br>WVRQAPGKGLEWVSGISGSGGMTMYADSVKGRFTI<br>SRDNSKNTLYLQMNSLRAEDTAVYYCARDIVGPYS<br>AGLFDYWGRGTLVTVSS |
| 539B-<br>X0049-<br>C02 | X49-C02-P<br>at H52a M<br>at H58-TYR<br>(Y) | DIQMTQSPSSLSASVGDRVTITCRASQSIYTYLNW<br>YQQKPGKAPKLLIYAASSLQSGVPSRFSGSGSGTD<br>FTLTISSLQPEDFATYYCQQAGIFGQGTKLEIK | EVQLLESGGGLVQPGGSLRLSCAASGFTFSDYWMH<br>WVRQAPGKGLEWVSGISGSGGMTYYADSVKGRFTI<br>SRDNSKNTLYLQMNSLRAEDTAVYYCARDIVGPYS<br>AGLFDYWGRGTLVTVSS |
| 539B-<br>X0049-<br>D02 | X49Y-D02-P<br>at H52a M<br>at H56,<br>H58-SER,<br>TYR<br>(S, Y) | DIQMTQSPSSLSASVGDRVTITCRASQSIYTYLNM<br>YQQKPGKAPKLLIYAASSLQSGVPSRFSGSGSGTD<br>FTLTISSLQPEDFATYYCQQAGIFGQGTKLEIK | EVQLLESGGGLVQPGGSLRLSCAASGFTFSDYWMH<br>WVRQAPGKGLEWVSGISGSGGSTYYADSVKGRFTI<br>SRDNSKNTLYLQMNSLRAEDTAVYYCARDIVGPYS<br>AGLFDYWGRGTLVTVSS |
| 539B-<br>X0049-<br>E02 | X49-E02-P<br>at H52a M<br>at H34,<br>H56, H58-<br>LEU, SER,<br>TYR<br>(L, S, Y) | DIQMTQSPSSLSASVGDRVTITCRASQSIYTYLNW<br>YQQKPGKAPKLLIYAASSLQSGVPSRFSGSGSGTD<br>FTLTISSLQPEDFATYYCQQAGIFGQGTKLEIK | EVQLLESGGGLVQPGGSLRLSCAASGFTFSDYWLH<br>WVRQAPGKGLEWVSGISGSGGSTYYADSVKGRFTI<br>SRDNSKNTLYLQMNSLRAEDTAVYYCARDIVGPYS<br>AGLFDYWGRGTLVTVSS |

SEQUENCE LISTING (3402 sequences)

SEQ ID NO: 1 - protein, 58 aa, Artificial Sequence
  Description of Artificial Sequence: Synthetic polypeptide
MHSFCAFKAETGPCRARFDRWFFNIFTRQCEEFIYGGCEGNQNRFESLEECKKMCTRD

SEQ ID NO: 2 - DNA, 1693 bp, Homo sapiens
atgaagtttcttctaatactgctcctgcaggccactgcttctggagctcttcccctgaacagctctacaagcctggaaaaaaataatgtgctatttggtgaaagatacttagaaaaattttatggccttgagataaacaaacttccagtgacaaaaatgaaatatagtggaaacttaatgaaggaaaaaatccaagaaatgcagcacttcttgggtctgaaagtgaccgggcaactggacacatctaccctggagatgatgcacgcacctcgatgtggagtccccgatgtccatcatttcagggaaatgccaggggggcccgtatggaggaaacattatatcacctacagaatcaataattacacacctgacatgaaccgtgaggatgttgactacgcaatccggaaagctttccaagtatggagtaatgttacccccttgaaattcagcaagattaacacaggcatggctgacattttggtggtttttgcccgtggagctcatggagacttccatgcttttgatggcaaaggtggaatcctagcccatgcttttggacctggatctggcattggaggggatgcacatttcgatgaggacgaattctggactacacattcaggaggcacaaacttgttcctcactgctgttcacgagattggccattccttaggtcttggccattctagtgatccaaaggccgtaatgttccccacctacaaatatgttgacatcaacacatttcgcctctctgctgatgacatacgtggcattcagtccctgtatggagacccaaaagagaaccaacgcttgccaaatcctgacaattcagaaccagctctctgtgaccccaatttgagttttgatgctgtcactaccgtgggaaataagatctttttcttcaaagacaggttcttctggctgaaggtttctgagagaccaaagaccagtgttaatttaatttcttccttatggccaaccttgccatctggcattgaagctgcttatgaaattgaagccagaaatcaagtttttctttttaaagatgacaaatactggttaattagcaatttaagaccagagccaaattatcccaagagcatacattcttttggttttcctaactttgtgaaaaaaattgatgcagctgtttttaacccacgtttttataggacctacttctttgtagataaccagtattggaggtatgatgaaaggagacagatgatggaccctggttatcccaaactgattaccaagaacttccaaggaatcgggcctaaaattgatgcagtcttctactctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaaggccaagagaattctatttgaagcatgctctgtaagttgcttcctaacat

SEQ ID NO: 3 - protein, 470 aa, Homo sapiens
MKFLLILLLQATASGALPLNSSTSLEKNNVLFGERYLEKFYGLEINKLPVTKMKYSGNLMKEKIQEMQHFLGLKVTGQLDTSTLEMMHAPRCGVPDVHHFREMPGGPVWRKHYITYRINNYTPDMNREDVDYAIRKAFQVWSNVTPLKFSKINTGMADILVVFARGAHGDFHAFDGKGGILAHAFGPGSGIGGDAHFDEDEFWTTHSGGTNLFLTAVHEIGHSLGLGHSSDPKAVMFPTYKYVDINTFRLSADDIRGIQSLYGDPKENQRLPNPDNSEPALCDPNLSFDAVTTVGNKIFFFKDRFFWLKVSERPKTSVNLISSLWPTLPSGIEAAYEIEARNQVFLFKDDKYWLISNLRPEPNYPKSIHSFGFPNFVKKIDAAVFNPRFYRTYFFVDNQYWRYDERRQMMDPGYPKLITKNFQGIGPKIDAVFYSKNKYYYFFQGSNQFEYDFLLQRITKTLKSNSWFGC

SEQ ID NO: 4 - DNA, 1410 bp, Mus musculus
actctgctgaaaggagtctgcacaatgaaatttctcatgatgattgtgttcttacaggtatctgcctgtggggctgctcccatgaatgacagtgaatttgctgaatggtacttgtcaagattttatgattatggaaaggacagaattccaatgacaaaaacaaaaaccaatagaaacttcctaaaagaaaaactccaggaaatgcagcagttctttgggctagaagcaactgggcaactggacaactcaactctggcaataatgcacatccctcgatgtggagtgcccgatgtacagcatcttagagcagtgccccagaggtcaagatggatgaagcggtacctcacttacaggatctataattacactccggacatgaagcgtgaggatgtagactacatatttcagaaagctttccaagtctggagtgatgtgactcctctaagattcagaaagcttcataaagatgaggctgacattatgatactttttgcatttggagctcacggagacttcaactattttgatggcaaaggtggtacactagcccatgctttttatcctggacctggtattcaaggagatgcacattttgatgaggcagaaacgtggactaaaagttttcaaggcacaaacctcttccttgttgctgttcatgaacttggccattccttggggctgcagcattccaataatccaaagtcaataatgtaccccacctacagataccttaaccccagcacatttcgcctctctgctgatgacatacgtaacattcagtccctctatggagccccagtgaaacccccatccttgacaaaacctagcagtccaccatcaactttctgtcaccaaagcttgagttttgatgctgtcacaacagtgggagagaaaatctttttctttaaagactggttcttctggtggaagcttcctgggagtccagccaccaacattacttctatttcttccatatggccaagcatcccatctggtattcaagctgcttacgaaattgaaagcagaaatcaacttttcctttttaaagatgagaagtactggttaataaacaacttagtaccagagccacactatcccaggagcatatattccctgggcttctctgcatctgtgaagaaggttgatgcagctgtctttgacccacttcgccaaaaggtttatttctttgtggataaacactactggaggtatgatgtgaggcaggagctcatggaccctgcttaccccaagctgatttccacacacttcccaggaatcaagcctaaaattgatgcagtcctctatttcaaaagacactactacatcttccaaggagcctatcaattggaatatgaccccctgttccgtcgtgtcaccaaaacattgaaaagtacaagctggtttggttgt

SEQ ID NO: 5 - protein, 462 aa, Mus musculus
MKFLMMIVFLQVSACGAAPMNDSEFAEWYLSRFYDYGKDRIPMTKTKTNRNFLKEKLQEMQQFFGLEATGQLDNSTLAIMHIPRCGVPDVQHLRAVPQRSRWMKRYLTYRIYNYTPDMKREDVDYIFQKAFQVWSDVTPLRFRKLHKDEADIMILFAFGAHGDFNYFDGKGGTLAHAFYPGPGIQGDAHFDEAETWTKSFQGTNLFLVAVHELGHSLGLQHSNNPKSIMYPTYRYLNPSTFRLSADDIRNIQSLYGAPVKPPSLTKPSSPPSTFCHQSLSFDAVTTVGEKIFFFKDWFFWWKLPGSPATNITSISSIWPSIPSGIQAAYEIESRNQLFLFKDEKYWLINNLVPEPHYPRSIYSLGFSASVKKVDAAVFDPLRQKVYFFVDKHYWRYDVRQELMDPAYPKLISTHFPGIKPKIDAVLYFKRHYYIFQGAYQLEYDPLFRRVTKTLKSTSWFGC

SEQ ID NO: 6 - protein, 8 aa, Artificial Sequence
  Description of Artificial Sequence: Synthetic peptide
  MOD_RES (1)..(1): 7-Methoxycoumarin-4-acetyl-Pro
  MOD_RES (4)..(4): Cys(4-Methoxybenzyl)
  MOD_RES (8)..(8): Diaminopropionyl(dinitrophenyl)
PLACWARX

SEQ ID NO: 7 - protein, 12 aa, Artificial Sequence
  Description of Artificial Sequence: Synthetic peptide
GDAHFDEDEFWT

SEQ ID NO: 8 - protein, 18 aa, Artificial Sequence
  Description of Artificial Sequence: Synthetic peptide
GTNLFLTAVHEIGHSLGL

SEQ ID NO: 9 - protein, 12 aa, Artificial Sequence
  Description of Artificial Sequence: Synthetic peptide
HEIGHSLGLGHS

SEQ ID NO: 10 - protein, 18 aa, Artificial Sequence
  Description of Artificial Sequence: Synthetic peptide
TYRINNYTPDMNREDVDY

SEQ ID NO: 11 - protein, 17 aa, Artificial Sequence
  Description of Artificial Sequence: Synthetic peptide
TFRLSADDIRGIQSLYG

SEQ ID NO: 12 - protein, 5 aa, Artificial Sequence
  Description of Artificial Sequence: Synthetic peptide
DYNMH

SEQ ID NO: 13 - protein, 5 aa, Artificial Sequence
  Description of Artificial Sequence: Synthetic peptide
WYWMG

SEQ ID NO: 14 - protein, 5 aa, Artificial Sequence
  Description of Artificial Sequence: Synthetic peptide
PYWMH

SEQ ID NO: 15 - protein, 5 aa, Artificial Sequence
  Description of Artificial Sequence: Synthetic peptide
PYWMS

SEQ ID NO: 16 - protein, 5 aa, Artificial Sequence
  Description of Artificial Sequence: Synthetic peptide
WYWMV

SEQ ID NO: 17 - protein, 5 aa, Artificial Sequence
  Description of Artificial Sequence: Synthetic peptide
WYNMH

SEQ ID NO: 18 - protein, 5 aa, Artificial Sequence
  Description of Artificial Sequence: Synthetic peptide
WYGMG

SEQ ID NO: 19 - protein, 5 aa, Artificial Sequence
  Description of Artificial Sequence: Synthetic peptide
YYGMG

SEQ ID NO: 20 - protein, 5 aa, Artificial Sequence
  Description of Artificial Sequence: Synthetic peptide
WYWMH

SEQ ID NO: 21 - protein, 5 aa, Artificial Sequence
  Description of Artificial Sequence: Synthetic peptide
WYNMS

SEQ ID NO: 22 - protein, 5 aa, Artificial Sequence
  Description of Artificial Sequence: Synthetic peptide
YYNMH

SEQ ID NO: 23 - protein, 5 aa, Artificial Sequence
  Description of Artificial Sequence: Synthetic peptide
LYHMH

SEQ ID NO: 24 - protein, 5 aa, Artificial Sequence
  Description of Artificial Sequence: Synthetic peptide
EYWMT

SEQ ID NO: 25 - protein, 5 aa, Artificial Sequence
  Description of Artificial Sequence: Synthetic peptide
PYWMH

SEQ ID NO: 26 - protein, 5 aa, Artificial Sequence
  Description of Artificial Sequence: Synthetic peptide
PYWMH

SEQ ID NO: 27 - protein, 17 aa, Artificial Sequence
  Description of Artificial Sequence: Synthetic peptide
YIGPSGGYTHYADSVKG

SEQ ID NO: 28 - protein, 17 aa, Artificial Sequence
  Description of Artificial Sequence: Synthetic peptide
SISPSGGYTFYADSVKG

SEQ ID NO: 29 - protein, 17 aa, Artificial Sequence
  Description of Artificial Sequence: Synthetic peptide
GIGPSGGLTFYADSVKG

SEQ ID NO: 30 - protein, 17 aa, Artificial Sequence
  Description of Artificial Sequence: Synthetic peptide
GISPSGGITFYADSVKG

SEQ ID NO: 31 - protein, 17 aa, Artificial Sequence
  Description of Artificial Sequence: Synthetic peptide
SIGPSGGDTYYADSVKG

SEQ ID NO: 32 - protein, 17 aa, Artificial Sequence
  Description of Artificial Sequence: Synthetic peptide
GISPSGGNTMYADSVKG

SEQ ID NO: 33 - protein, 17 aa, Artificial Sequence
  Description of Artificial Sequence: Synthetic peptide
VIVSSGGFTQYADSVKG

SEQ ID NO: 34 - protein, 17 aa, Artificial Sequence
  Description of Artificial Sequence: Synthetic peptide
VISSSGGFTFYADSVKG

SEQ ID NO: 35 - protein, 17 aa, Artificial Sequence
  Description of Artificial Sequence: Synthetic peptide
GIVSSGGTTIYADSVKG

SEQ ID NO: 36 - protein, 17 aa, Artificial Sequence
  Description of Artificial Sequence: Synthetic peptide
RISPSGGDTGYADSVKG

SEQ ID NO: 37 - protein, 17 aa, Artificial Sequence
  Description of Artificial Sequence: Synthetic peptide
GIGPSGGGTLYADSVKG

SEQ ID NO: 38 - protein, 17 aa, Artificial Sequence
  Description of Artificial Sequence: Synthetic peptide
GIGPSGGWTIYADSVKG

SEQ ID NO: 39 - protein, 17 aa, Artificial Sequence
  Description of Artificial Sequence: Synthetic peptide
GISPSGGMTFYADSVKG

SEQ ID NO: 40 - protein, 17 aa, Artificial Sequence
  Description of Artificial Sequence: Synthetic peptide
GISSSGGDTLYADSVKG

SEQ ID NO: 41 - protein, 17 aa, Artificial Sequence
  Description of Artificial Sequence: Synthetic peptide
GIGPSGGPTFYADSIKG

SEQ ID NO: 42 - protein, 35 aa, Artificial Sequence
  Description of Artificial Sequence: Synthetic polypeptide
DYNMHYIGPSGGYTHYADSVKGDIRGAYSSGLFDY

SEQ ID NO: 43 - protein, 35 aa, Artificial Sequence
  Description of Artificial Sequence: Synthetic polypeptide
WYWMHGISPSGGMTMYADSVKGDIVGPYSAGLFDY

SEQ ID NO: 44 - protein, 35 aa, Artificial Sequence
  Description of Artificial Sequence: Synthetic polypeptide
WYGMHGIVSSGGETFYADSVKGDIRGVFLSGLFDH

SEQ ID NO: 45 - protein, 35 aa, Artificial Sequence
  Description of Artificial Sequence: Synthetic polypeptide
YYNMHGISPSGGTTFYADSVKGDITGAYSAGLFDL

SEQ ID NO: 46 - protein, 35 aa, Artificial Sequence
  Description of Artificial Sequence: Synthetic polypeptide
EYNMHGIVPSGGLTHYADSVKGDIRGAYSAGIFDY

SEQ ID NO: 47 - protein, 662 aa, Artificial Sequence
  Description of Artificial Sequence: Synthetic polypeptide
DIQMTQSPSSLSASVGDRVTITCRASQSIYTYLNWYQQKPGKAPKLLIYAASSLQSGVPSRFSGSGSGTDFTLTISSLQPEDFATYYCQQAGIFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLLESGGGLVQPGGSLRLSCAASGFTFSWYWMHWVRQAPGKGLEWVSGISPSGGMTMYADSVKGRFTISRDNSKNTLYLQMNSLRAEDTAVYYCARDIVGPYSAGLFDYWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 48 - protein, 662 aa, Artificial Sequence
  Description of Artificial Sequence: Synthetic polypeptide
DIQMTQSPSSLSASVGDRVTITCRASQSIYTYLNWYQQKPGKAPKLLIYAASSLQSGVPSRFSGSGSGTDFTLTISSLQPEDFATYYCQQAGIFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLLESGGGLVQPGGSLRLSCAASGFTFSDYNMHWVRQAPGKGLEWVSYIGPSGGYTHYADSVKGRFTISRDNSKNTLYLQMNSLRAEDTAVYYCAKDIRGAYSSGLFDYWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - protein, 662 aa, Artificial Sequence
  Description of Artificial Sequence: Synthetic polypeptide
DIQMTQSPSSLSASVGDRVTITCRASQSIYTYLNWYQQKPGKAPKLLIYAASSLQSGVPSRFSGSGSGTDFTLTISSLQPEDFATYYCQQAGIFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLLESGGGLVQPGGSLRLSCAASGFTFSWYGMHWVRQAPGKGLEWVSGIVSSGGETFYADSVKGRFTISRDNSKNTLYLQMNSLRAEDTAVYYCAKDIRGVFLSGLFDHWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - protein, 24 aa, Artificial Sequence
  Description of Artificial Sequence: Synthetic peptide
QDIQMTQSPSSLSASVGDRVTITC

SEQ ID NO: 51 - protein, 24 aa, Artificial Sequence
  Description of Artificial Sequence: Synthetic peptide
QDIQMTQSPSSLSASVGDRVTITC

SEQ ID NO: 52 - protein, 24 aa, Artificial Sequence
  Description of Artificial Sequence: Synthetic peptide
QDIQMTQSPSSLSASVGDRVTITC

SEQ ID NO: 53 - protein, 24 aa, Artificial Sequence
  Description of Artificial Sequence: Synthetic peptide
QDIQMTQSPSSLSASVGDRVTITC

SEQ ID NO: 54 - protein, 24 aa, Artificial Sequence
  Description of Artificial Sequence: Synthetic peptide
QDIQMTQSPSSLSASVGDRVTITC

SEQ ID NO: 55 - protein, 24 aa, Artificial Sequence
  Description of Artificial Sequence: Synthetic peptide
QDIQMTQSPSSLSASVGDRVTITC

SEQ ID NO: 56 - protein, 24 aa, Artificial Sequence
  Description of Artificial Sequence: Synthetic peptide
QDIQMTQSPSSLSASVGDRVTITC

SEQ ID NO: 57 - protein, 24 aa, Artificial Sequence
  Description of Artificial Sequence: Synthetic peptide
QDIQMTQSPSSLSASVGDRVTITC

SEQ ID NO: 58 - protein, 24 aa, Artificial Sequence
  Description of Artificial Sequence: Synthetic peptide
QDIQMTQSPSSLSASVGDRVTITC

SEQ ID NO: 59 - protein, 24 aa, Artificial Sequence
  Description of Artificial Sequence: Synthetic peptide
QDIQMTQSPSSLSASVGDRVTITC

SEQ ID NO: 60 - protein, 24 aa, Artificial Sequence
  Description of Artificial Sequence: Synthetic peptide
QDIQMTQSPSSLSASVGDRVTITC

SEQ ID NO: 61 - protein, 24 aa, Artificial Sequence
  Description of Artificial Sequence: Synthetic peptide
QDIQMTQSPSSLSASVGDRVTITC

SEQ ID NO: 62 - protein, 24 aa, Artificial Sequence
  Description of Artificial Sequence: Synthetic peptide
QDIQMTQSPSSLSASVGDRVTITC

SEQ ID NO: 63 - protein, 24 aa, Artificial Sequence
  Description of Artificial Sequence: Synthetic peptide
QDIQMTQSPSSLSASVGDRVTITC

SEQ ID NO: 64 - protein, 24 aa, Artificial Sequence
  Description of Artificial Sequence: Synthetic peptide
QDIQMTQSPSSLSASVGDRVTITC

SEQ ID NO: 65 - protein, 24 aa, Artificial Sequence
  Description of Artificial Sequence: Synthetic peptide
QDIQMTQSPSSLSASVGDRVTITC

SEQ ID NO: 66 - protein, 24 aa, Artificial Sequence
  Description of Artificial Sequence: Synthetic peptide
QDIQMTQSPSSLSASVGDRVTITC

SEQ ID NO: 67 - protein, 24 aa, Artificial Sequence
  Description of Artificial Sequence: Synthetic peptide
QDIQMTQSPSSLSASVGDRVTITC

SEQ ID NO: 68 - protein, 24 aa, Artificial Sequence
  Description of Artificial Sequence: Synthetic peptide
QDIQMTQSPSSLSASVGDRVTITC

SEQ ID NO: 69 - protein, 24 aa, Artificial Sequence
  Description of Artificial Sequence: Synthetic peptide
QDIQMTQSPSSLSASVGDRVTITC

SEQ ID NO: 70 - protein, 24 aa, Artificial Sequence
  Description of Artificial Sequence: Synthetic peptide
QDIQMTQSPSSLSASVGDRVTITC

SEQ ID NO: 71 - protein, 24 aa, Artificial Sequence
  Description of Artificial Sequence: Synthetic peptide
QDIQMTQSPSSLSASVGDRVTITC

SEQ ID NO: 72 - protein, 24 aa, Artificial Sequence
  Description of Artificial Sequence: Synthetic peptide
QDIQMTQSPSSLSASVGDRVTITC

SEQ ID NO: 73 - protein, 24 aa, Artificial Sequence
  Description of Artificial Sequence: Synthetic peptide
QDIQMTQSPSSLSASVGDRVTITC

SEQ ID NO: 74 - protein, 24 aa, Artificial Sequence
  Description of Artificial Sequence: Synthetic peptide
QDIQMTQSPSSLSASVGDRVTITC

SEQ ID NO: 75 - protein, 24 aa, Artificial Sequence
  Description of Artificial Sequence: Synthetic peptide
QDIQMTQSPSSLSASVGDRVTITC

SEQ ID NO: 76 - protein, 24 aa, Artificial Sequence
  Description of Artificial Sequence: Synthetic peptide
QDIQMTQSPSSLSASVGDRVTITC

SEQ ID NO: 77 - protein, 24 aa, Artificial Sequence
  Description of Artificial Sequence: Synthetic peptide
QDIQMTQSPSSLSASVGDRVTITC

SEQ ID NO: 78 - protein, 24 aa, Artificial Sequence
  Description of Artificial Sequence: Synthetic peptide
QDIQMTQSPSSLSASVGDRVTITC

SEQ ID NO: 79 - protein, 24 aa, Artificial Sequence
  Description of Artificial Sequence: Synthetic peptide
QDIQMTQSPSSLSASVGDRVTITC

SEQ ID NO: 80 - protein, 24 aa, Artificial Sequence
  Description of Artificial Sequence: Synthetic peptide
QDIQMTQSPSSLSASVGDRVTITC

SEQ ID NO: 81 - protein, 24 aa, Artificial Sequence
  Description of Artificial Sequence: Synthetic peptide
QDIQMTQSPSSLSASVGDRVTITC

SEQ ID NO: 82 - protein, 24 aa, Artificial Sequence
  Description of Artificial Sequence: Synthetic peptide
QDIQMTQSPGTLSLSPGERATMSC

SEQ ID NO: 83 - protein, 24 aa, Artificial Sequence
  Description of Artificial Sequence: Synthetic peptide
QDIQMTQSPSSLSASVGDRVTITC

SEQ ID NO: 84 - protein, 11 aa, Artificial Sequence
  Description of Artificial Sequence: Synthetic peptide
RANQSIYTYLN

SEQ ID NO: 85 - protein, 11 aa, Artificial Sequence
  Description of Artificial Sequence: Synthetic peptide
RANQSIYTYLN

SEQ ID NO: 86 - protein, 11 aa, Artificial Sequence
  Description of Artificial Sequence: Synthetic peptide
RANQSIYTYLN

SEQ ID NO: 87 - protein, 11 aa, Artificial Sequence
  Description of Artificial Sequence: Synthetic peptide
RANQSIYTYLN

SEQ ID NO: 88 - protein, 11 aa, Artificial Sequence
  Description of Artificial Sequence: Synthetic peptide
RANQSIYTYLN

SEQ ID NO: 89 - protein, 11 aa, Artificial Sequence
  Description of Artificial Sequence: Synthetic peptide
RANQSIYTYLN

SEQ ID NO: 90 - protein, 11 aa, Artificial Sequence
  Description of Artificial Sequence: Synthetic peptide
RANQSIYTYLN

SEQ ID NO: 91 - protein, 11 aa, Artificial Sequence
  Description of Artificial Sequence: Synthetic peptide
RANQSIYTYLN

SEQ ID NO: 92 - protein, 11 aa, Artificial Sequence
  Description of Artificial Sequence: Synthetic peptide
RANQSIYTYLN

SEQ ID NO: 93 - protein, 11 aa, Artificial Sequence
  Description of Artificial Sequence: Synthetic peptide
RANQSIYTYLN

SEQ ID NO: 94 - protein, 11 aa, Artificial Sequence
  Description of Artificial Sequence: Synthetic peptide
RANQSIYTYLN

SEQ ID NO: 95 - protein, 11 aa, Artificial Sequence
  Description of Artificial Sequence: Synthetic peptide
RANQSIYTYLN

SEQ ID NO: 96 - protein, 11 aa, Artificial Sequence
  Description of Artificial Sequence: Synthetic peptide
RANQSIYTYLN

SEQ ID NO: 97 - protein, 11 aa, Artificial Sequence
  Description of Artificial Sequence: Synthetic peptide
RANQSIYTYLN

SEQ ID NO: 98 - protein, 11 aa, Artificial Sequence
  Description of Artificial Sequence: Synthetic peptide
RANQSIYTYLN

SEQ ID NO: 99 - protein, 11 aa, Artificial Sequence
  Description of Artificial Sequence: Synthetic peptide
RANQSIYTYLN

SEQ ID NO: 100 - protein, 11 aa, Artificial Sequence
  Description of Artificial Sequence: Synthetic peptide
RANQSIYTYLN

SEQ ID NO: 101 - protein, 11 aa, Artificial Sequence
  Description of Artificial Sequence: Synthetic peptide
RANQSIYTYLN

SEQ ID NO: 102 - protein, 11 aa, Artificial Sequence
  Description of Artificial Sequence: Synthetic peptide
RANQSIYTYLN

SEQ ID NO: 103 - protein, 11 aa, Artificial Sequence
  Description of Artificial Sequence: Synthetic peptide
RANQSIYTYLN

SEQ ID NO: 104 - protein, 11 aa, Artificial Sequence
  Description of Artificial Sequence: Synthetic peptide
RANQSIYTYLN

SEQ ID NO: 105 - protein, 11 aa, Artificial Sequence
  Description of Artificial Sequence: Synthetic peptide
RANQSIYTYLN

SEQ ID NO: 106 - protein, 11 aa, Artificial Sequence
  Description of Artificial Sequence: Synthetic peptide
RANQSIYTYLN

SEQ ID NO: 107 - protein, 11 aa, Artificial Sequence
  Description of Artificial Sequence: Synthetic peptide
RANQSIYTYLN

SEQ ID NO: 108 - protein, 11 aa, Artificial Sequence
  Description of Artificial Sequence: Synthetic peptide
RANQSIYTYLN

SEQ ID NO: 109 - protein, 11 aa, Artificial Sequence
  Description of Artificial Sequence: Synthetic peptide
RANQSIYTYLN

SEQ ID NO: 110 - protein, 11 aa, Artificial Sequence
  Description of Artificial Sequence: Synthetic peptide
RANQSIYTYLN

SEQ ID NO: 111 - protein, 11 aa, Artificial Sequence
  Description of Artificial Sequence: Synthetic peptide
RANQSIYTYLN

SEQ ID NO: 112 - protein, 11 aa, Artificial Sequence
  Description of Artificial Sequence: Synthetic peptide
RASQSISSYLN

SEQ ID NO: 113 - protein, 11 aa, Artificial Sequence
  Description of Artificial Sequence: Synthetic peptide
RANQSIYTYLN

SEQ ID NO: 114 - protein, 11 aa, Artificial Sequence
  Description of Artificial Sequence: Synthetic peptide
RANQSIYTYLN

SEQ ID NO: 115 - protein, 11 aa, Artificial Sequence
  Description of Artificial Sequence: Synthetic peptide
RANQSIYTYLN

SEQ ID NO: 116 - protein, 12 aa, Artificial Sequence
  Description of Artificial Sequence: Synthetic peptide
RASQSFTGSYLA

SEQ ID NO: 117 - protein, 11 aa, Artificial Sequence
  Description of Artificial Sequence: Synthetic peptide
RANQSIYTYLN

SEQ ID NO: 118 - protein, 15 aa, Artificial Sequence
  Description of Artificial Sequence: Synthetic peptide
WYQQKPGKAPELLIY

SEQ ID NO: 119 - protein, 15 aa, Artificial Sequence
  Description of Artificial Sequence: Synthetic peptide
WYQQKPGKAPELLIY

SEQ ID NO: 120 - protein, 15 aa, Artificial Sequence
  Description of Artificial Sequence: Synthetic peptide
WYQQKPGKAPELLIY

SEQ ID NO: 121 - protein, 15 aa, Artificial Sequence
  Description of Artificial Sequence: Synthetic peptide
WYQQKPGKAPELLIY

SEQ ID NO: 122 - protein, 15 aa, Artificial Sequence
  Description of Artificial Sequence: Synthetic peptide
WYQQKPGKAPELLIY

SEQ ID NO: 123 - protein, 15 aa, Artificial Sequence
  Description of Artificial Sequence: Synthetic peptide
WYQQKPGKAPELLIY

SEQ ID NO: 124 - protein, 15 aa, Artificial Sequence
  Description of Artificial Sequence: Synthetic peptide
WYQQKPGKAPELLIY

SEQ ID NO: 125 - protein, 15 aa, Artificial Sequence
  Description of Artificial Sequence: Synthetic peptide
WYQQKPGKAPELLIY

SEQ ID NO: 126 - protein, 15 aa, Artificial Sequence
  Description of Artificial Sequence: Synthetic peptide
WYQQKPGKAPELLIY

SEQ ID NO: 127 - protein, 15 aa, Artificial Sequence
  Description of Artificial Sequence: Synthetic peptide
WYQQKPGKAPELLIY

SEQ ID NO: 128 - protein, 15 aa, Artificial Sequence
  Description of Artificial Sequence: Synthetic peptide
WYQQKPGKAPELLIY

SEQ ID NO: 129 - protein, 15 aa, Artificial Sequence
  Description of Artificial Sequence: Synthetic peptide
WYQQKPGKAPELLIY

SEQ ID NO: 130 - protein, 15 aa, Artificial Sequence
  Description of Artificial Sequence: Synthetic peptide
WYQQKPGKAPELLIY

SEQ ID NO: 131 - protein, 15 aa, Artificial Sequence
  Description of Artificial Sequence: Synthetic peptide
WYQQKPGKAPELLIY

SEQ ID NO: 132 - protein, 15 aa, Artificial Sequence
  Description of Artificial Sequence: Synthetic peptide
WYQQKPGKAPELLIY

SEQ ID NO: 133 - protein, 15 aa, Artificial Sequence
  Description of Artificial Sequence: Synthetic peptide
WYQQKPGKAPELLIY

SEQ ID NO: 134 - protein, 15 aa, Artificial Sequence
  Description of Artificial Sequence: Synthetic peptide
WYQQKPGKAPELLIY

SEQ ID NO: 135 - protein, 15 aa, Artificial Sequence
  Description of Artificial Sequence: Synthetic peptide
WYQQKPGKAPELLIY

SEQ ID NO: 136 - protein, 15 aa, Artificial Sequence
  Description of Artificial Sequence: Synthetic peptide
WYQQKPGKAPELLIY

SEQ ID NO: 137 - protein, 15 aa, Artificial Sequence
  Description of Artificial Sequence: Synthetic peptide
WYQQKPGKAPELLIY

SEQ ID NO: 138 - protein, 15 aa, Artificial Sequence
  Description of Artificial Sequence: Synthetic peptide
WYQQKPGKAPELLIY

SEQ ID NO: 139 - protein, 15 aa, Artificial Sequence
  Description of Artificial Sequence: Synthetic peptide
WYQQKPGKAPELLIY

SEQ ID NO: 140 - protein, 15 aa, Artificial Sequence
  Description of Artificial Sequence: Synthetic peptide
WYQQKPGKAPELLIY

SEQ ID NO: 141 - protein, 15 aa, Artificial Sequence
  Description of Artificial Sequence: Synthetic peptide
WYQQKPGKAPELLIY

SEQ ID NO: 142 - protein, 15 aa, Artificial Sequence
  Description of Artificial Sequence: Synthetic peptide
WYQQKPGKAPELLIY

SEQ ID NO: 143 - protein, 15 aa, Artificial Sequence
  Description of Artificial Sequence: Synthetic peptide
WYQQKPGKAPELLIY

SEQ ID NO: 144 - protein, 15 aa, Artificial Sequence
  Description of Artificial Sequence: Synthetic peptide
WYQQKPGKAPELLIY

SEQ ID NO: 145 - protein, 15 aa, Artificial Sequence
  Description of Artificial Sequence: Synthetic peptide
WYQQKPGKAPELLIY

SEQ ID NO: 146 - protein, 15 aa, Artificial Sequence
  Description of Artificial Sequence: Synthetic peptide
WYQQKPGKAPKLLIY

SEQ ID NO: 147 - protein, 15 aa, Artificial Sequence
  Description of Artificial Sequence: Synthetic peptide
WYQQKPGKAPELLIY

SEQ ID NO: 148 - protein, 15 aa, Artificial Sequence
  Description of Artificial Sequence: Synthetic peptide
WYQQKPGKAPELLIY

SEQ ID NO: 149 - protein, 15 aa, Artificial Sequence
  Description of Artificial Sequence: Synthetic peptide
WYQQKPGKAPELLIY

SEQ ID NO: 150 - protein, 15 aa, Artificial Sequence
  Description of Artificial Sequence: Synthetic peptide
WYQQKPGLAPRLLIY

SEQ ID NO: 151 - protein, 15 aa, Artificial Sequence
  Description of Artificial Sequence: Synthetic peptide
WYQQKPGKAPELLIY

SEQ ID NO: 152 - protein, 7 aa, Artificial Sequence
  Description of Artificial Sequence: Synthetic peptide
AASSLQS

SEQ ID NO: 153 - protein, 7 aa, Artificial Sequence
  Description of Artificial Sequence: Synthetic peptide
AASSLQS

SEQ ID NO: 154 - protein, 7 aa, Artificial Sequence
  Description of Artificial Sequence: Synthetic peptide
AASSLQS

SEQ ID NO: 155 - protein, 7 aa, Artificial Sequence
  Description of Artificial Sequence: Synthetic peptide
AASSLQS

SEQ ID NO: 156 - protein, 7 aa, Artificial Sequence
  Description of Artificial Sequence: Synthetic peptide
AASSLQS

SEQ ID NO: 157 - protein, 7 aa, Artificial Sequence
  Description of Artificial Sequence: Synthetic peptide
AASSLQS

SEQ ID NO: 158 - protein, 7 aa, Artificial Sequence
  Description of Artificial Sequence: Synthetic peptide
AASSLQS

SEQ ID NO: 159 - protein, 7 aa, Artificial Sequence
  Description of Artificial Sequence: Synthetic peptide
AASSLQS

SEQ ID NO: 160 - protein, 7 aa, Artificial Sequence
  Description of Artificial Sequence: Synthetic peptide
AASSLQS

SEQ ID NO: 161 - protein, 7 aa, Artificial Sequence
  Description of Artificial Sequence: Synthetic peptide
AASSLQS

SEQ ID NO: 162 - protein, 7 aa, Artificial Sequence
  Description of Artificial Sequence: Synthetic peptide
AASSLQS

SEQ ID NO: 163 - protein, 7 aa, Artificial Sequence
  Description of Artificial Sequence: Synthetic peptide
AASSLQS

SEQ ID NO: 164 - protein, 7 aa, Artificial Sequence
  Description of Artificial Sequence: Synthetic peptide
AASSLQS

SEQ ID NO: 165 - protein, 7 aa, Artificial Sequence
  Description of Artificial Sequence: Synthetic peptide
AASSLQS

SEQ ID NO: 166 - protein, 7 aa, Artificial Sequence
  Description of Artificial Sequence: Synthetic peptide
AASSLQS

SEQ ID NO: 167 - protein, 7 aa, Artificial Sequence
  Description of Artificial Sequence: Synthetic peptide
AASSLQS

SEQ ID NO: 168 - protein, 7 aa, Artificial Sequence
  Description of Artificial Sequence: Synthetic peptide
AASSLQS

SEQ ID NO: 169 - protein, 7 aa, Artificial Sequence
  Description of Artificial Sequence: Synthetic peptide
AASSLQS

SEQ ID NO: 170 - protein, 7 aa, Artificial Sequence
  Description of Artificial Sequence: Synthetic peptide
AASSLQS

SEQ ID NO: 171 - protein, 7 aa, Artificial Sequence
  Description of Artificial Sequence: Synthetic peptide
AASSLQS

SEQ ID NO: 172 - protein, 7 aa, Artificial Sequence
  Description of Artificial Sequence: Synthetic peptide
AASSLQS

SEQ ID NO: 173 - protein, 7 aa, Artificial Sequence
  Description of Artificial Sequence: Synthetic peptide
AASSLQS

SEQ ID NO: 174 - protein, 7 aa, Artificial Sequence
  Description of Artificial Sequence: Synthetic peptide
AASSLQS

SEQ ID NO: 175 - protein, 7 aa, Artificial Sequence
  Description of Artificial Sequence: Synthetic peptide
AASSLQS

SEQ ID NO: 176 - protein, 7 aa, Artificial Sequence
  Description of Artificial Sequence: Synthetic peptide
AASSLQS

SEQ ID NO: 177 - protein, 7 aa, Artificial Sequence
  Description of Artificial Sequence: Synthetic peptide
AASSLQS

SEQ ID NO: 178 - protein, 7 aa, Artificial Sequence
  Description of Artificial Sequence: Synthetic peptide
AASSLQS

SEQ ID NO: 179 - protein, 7 aa, Artificial Sequence
  Description of Artificial Sequence: Synthetic peptide
AASSLQS

SEQ ID NO: 180 - protein, 7 aa, Artificial Sequence
  Description of Artificial Sequence: Synthetic peptide
AASSLQS

SEQ ID NO: 181 - protein, 7 aa, Artificial Sequence
  Description of Artificial Sequence: Synthetic peptide
AASSLQS

SEQ ID NO: 182 - protein, 7 aa, Artificial Sequence
  Description of Artificial Sequence: Synthetic peptide
AASSLQS

SEQ ID NO: 183 - protein, 7 aa, Artificial Sequence
  Description of Artificial Sequence: Synthetic peptide
AASSLQS

SEQ ID NO: 184 - protein, 7 aa, Artificial Sequence
  Description of Artificial Sequence: Synthetic peptide
DASSRAA

SEQ ID NO: 185 - protein, 7 aa, Artificial Sequence
  Description of Artificial Sequence: Synthetic peptide
AASSLQS

SEQ ID NO: 186 - protein, 32 aa, Artificial Sequence
  Description of Artificial Sequence: Synthetic peptide
GVPSRFSGSGSGTDFTLTISSLQPEDFATYYC

SEQ ID NO: 187 - protein, 32 aa, Artificial Sequence; identical to SEQ ID NO: 186
  Description of Artificial Sequence: Synthetic polypeptide

SEQ ID NO: 188 - protein, 32 aa, Artificial Sequence; identical to SEQ ID NO: 186
  Description of Artificial Sequence: Synthetic polypeptide

SEQ ID NO: 189 - protein, 32 aa, Artificial Sequence; identical to SEQ ID NO: 186
  Description of Artificial Sequence: Synthetic polypeptide

SEQ ID NO: 190 - protein, 32 aa, Artificial Sequence; identical to SEQ ID NO: 186
  Description of Artificial Sequence: Synthetic polypeptide

SEQ ID NO: 191 - protein, 32 aa, Artificial Sequence; identical to SEQ ID NO: 186
  Description of Artificial Sequence: Synthetic polypeptide

SEQ ID NO: 192 - protein, 32 aa, Artificial Sequence; identical to SEQ ID NO: 186
  Description of Artificial Sequence: Synthetic polypeptide

SEQ ID NO: 193 - protein, 32 aa, Artificial Sequence; identical to SEQ ID NO: 186
  Description of Artificial Sequence: Synthetic polypeptide

SEQ ID NO: 194 - protein, 32 aa, Artificial Sequence; identical to SEQ ID NO: 186
  Description of Artificial Sequence: Synthetic polypeptide

SEQ ID NO: 195 - protein, 32 aa, Artificial Sequence; identical to SEQ ID NO: 186
  Description of Artificial Sequence: Synthetic polypeptide

SEQ ID NO: 196 - protein, 32 aa, Artificial Sequence; identical to SEQ ID NO: 186
  Description of Artificial Sequence: Synthetic polypeptide

SEQ ID NO: 197 - protein, 32 aa, Artificial Sequence; identical to SEQ ID NO: 186
  Description of Artificial Sequence: Synthetic polypeptide

SEQ ID NO: 198 - protein, 32 aa, Artificial Sequence; identical to SEQ ID NO: 186
  Description of Artificial Sequence: Synthetic polypeptide

SEQ ID NO: 199 - protein, 32 aa, Artificial Sequence; identical to SEQ ID NO: 186
  Description of Artificial Sequence: Synthetic polypeptide

SEQ ID NO: 200 - protein, 32 aa, Artificial Sequence; identical to SEQ ID NO: 186
  Description of Artificial Sequence: Synthetic polypeptide

SEQ ID NO: 201 - protein, 32 aa, Artificial Sequence; identical to SEQ ID NO: 186
  Description of Artificial Sequence: Synthetic polypeptide

SEQ ID NO: 202 - protein, 32 aa, Artificial Sequence; identical to SEQ ID NO: 186
  Description of Artificial Sequence: Synthetic polypeptide

SEQ ID NO: 203 - protein, 32 aa, Artificial Sequence; identical to SEQ ID NO: 186
  Description of Artificial Sequence: Synthetic polypeptide

SEQ ID NO: 204 - protein, 32 aa, Artificial Sequence; identical to SEQ ID NO: 186
  Description of Artificial Sequence: Synthetic polypeptide

SEQ ID NO: 205 - protein, 32 aa, Artificial Sequence; identical to SEQ ID NO: 186
  Description of Artificial Sequence: Synthetic polypeptide

SEQ ID NO: 206 - protein, 32 aa, Artificial Sequence; identical to SEQ ID NO: 186
  Description of Artificial Sequence: Synthetic polypeptide

SEQ ID NO: 207 - protein, 32 aa, Artificial Sequence; identical to SEQ ID NO: 186
  Description of Artificial Sequence: Synthetic polypeptide

SEQ ID NO: 208 - protein, 32 aa, Artificial Sequence; identical to SEQ ID NO: 186
  Description of Artificial Sequence: Synthetic polypeptide

SEQ ID NO: 209 - protein, 32 aa, Artificial Sequence; identical to SEQ ID NO: 186
  Description of Artificial Sequence: Synthetic polypeptide

SEQ ID NO: 210 - protein, 32 aa, Artificial Sequence; identical to SEQ ID NO: 186
  Description of Artificial Sequence: Synthetic polypeptide

SEQ ID NO: 211 - protein, 32 aa, Artificial Sequence; identical to SEQ ID NO: 186
  Description of Artificial Sequence: Synthetic polypeptide

SEQ ID NO: 212 - protein, 32 aa, Artificial Sequence; identical to SEQ ID NO: 186
  Description of Artificial Sequence: Synthetic polypeptide

SEQ ID NO: 213 - protein, 32 aa, Artificial Sequence; identical to SEQ ID NO: 186
  Description of Artificial Sequence: Synthetic polypeptide

SEQ ID NO: 214 - protein, 32 aa, Artificial Sequence; identical to SEQ ID NO: 186
  Description of Artificial Sequence: Synthetic polypeptide

SEQ ID NO: 215 - protein, 32 aa, Artificial Sequence; identical to SEQ ID NO: 186
  Description of Artificial Sequence: Synthetic polypeptide

SEQ ID NO: 216 - protein, 32 aa, Artificial Sequence; identical to SEQ ID NO: 186
  Description of Artificial Sequence: Synthetic polypeptide

SEQ ID NO: 217 - protein, 32 aa, Artificial Sequence; identical to SEQ ID NO: 186
  Description of Artificial Sequence: Synthetic polypeptide

SEQ ID NO: 218 - protein, 32 aa, Artificial Sequence
  Description of Artificial Sequence: Synthetic polypeptide
GIPDRFSGSGSGTDFTLTISRLEPEDFAVYYC

SEQ ID NO: 219 - protein, 32 aa, Artificial Sequence; identical to SEQ ID NO: 186
  Description of Artificial Sequence: Synthetic polypeptide

SEQ ID NO: 220 - protein, 5 aa, Artificial Sequence
  Description of Artificial Sequence: Synthetic peptide
QQAGI

SEQ ID NO: 221 - protein, 5 aa, Artificial Sequence
  Description of Artificial Sequence: Synthetic peptide
QQAGI

SEQ ID NO: 222 - protein, 5 aa, Artificial Sequence
  Description of Artificial Sequence: Synthetic peptide
QQAGI

SEQ ID NO: 223 - protein, 5 aa, Artificial Sequence
  Description of Artificial Sequence: Synthetic peptide
QQAGI

SEQ ID NO: 224 - protein, 5 aa, Artificial Sequence
  Description of Artificial Sequence: Synthetic peptide
QQAGI

SEQ ID NO: 225 - protein, 5 aa, Artificial Sequence
  Description of Artificial Sequence: Synthetic peptide
QQAGI

SEQ ID NO: 226 - protein, 5 aa, Artificial Sequence
  Description of Artificial Sequence: Synthetic peptide
QQAGI

SEQ ID NO: 227 - protein, 5 aa, Artificial Sequence
  Description of Artificial Sequence: Synthetic peptide
QQAGI

SEQ ID NO: 228 - protein, 5 aa, Artificial Sequence
  Description of Artificial Sequence: Synthetic peptide
QQAGI

SEQ ID NO: 229 - protein, 5 aa, Artificial Sequence
  Description of Artificial Sequence: Synthetic peptide
QQAGI

SEQ ID NO: 230 - protein, 5 aa, Artificial Sequence
  Description of Artificial Sequence: Synthetic peptide
QQAGI

SEQ ID NO: 231 - protein, 5 aa, Artificial Sequence
  Description of Artificial Sequence: Synthetic peptide
QQAGI

SEQ ID NO: 232 - protein, 5 aa, Artificial Sequence
  Description of Artificial Sequence: Synthetic peptide
QQAGI

SEQ ID NO: 233 - protein, 5 aa, Artificial Sequence
  Description of Artificial Sequence: Synthetic peptide
QQAGI

SEQ ID NO: 234 - protein, 5 aa, Artificial Sequence
  Description of Artificial Sequence: Synthetic peptide
QQAGI

SEQ ID NO: 235 - protein, 5 aa, Artificial Sequence
  Description of Artificial Sequence: Synthetic peptide
QQAGI

SEQ ID NO: 236 - protein, 5 aa, Artificial Sequence
  Description of Artificial Sequence: Synthetic peptide
QQAGI

SEQ ID NO: 237 - protein, 5 aa, Artificial Sequence
  Description of Artificial Sequence: Synthetic peptide
QQAGI

SEQ ID NO: 238 - protein, 5 aa, Artificial Sequence
  Description of Artificial Sequence: Synthetic peptide
QQAGI

SEQ ID NO: 239 - protein, 5 aa, Artificial Sequence
  Description of Artificial Sequence: Synthetic peptide
QQAGI

SEQ ID NO: 240 - protein, 5 aa, Artificial Sequence
  Description of Artificial Sequence: Synthetic peptide
QQAGI

SEQ ID NO: 241 - protein, 5 aa, Artificial Sequence
  Description of Artificial Sequence: Synthetic peptide
QQAGI

SEQ ID NO: 242 - protein, 5 aa, Artificial Sequence
  Description of Artificial Sequence: Synthetic peptide
QQAGI

SEQ ID NO: 243 - protein, 5 aa, Artificial Sequence
  Description of Artificial Sequence: Synthetic peptide
QQAGI

SEQ ID NO: 244 - protein, 5 aa, Artificial Sequence
  Description of Artificial Sequence: Synthetic peptide
QQAGI

SEQ ID NO: 245 - protein, 5 aa, Artificial Sequence
  Description of Artificial Sequence: Synthetic peptide
QQAGI

SEQ ID NO: 246 - protein, 5 aa, Artificial Sequence
  Description of Artificial Sequence: Synthetic peptide
QQAGI

SEQ ID NO: 247 - protein, 5 aa, Artificial Sequence
  Description of Artificial Sequence: Synthetic peptide
QQAGI

SEQ ID NO: 248 - protein, 9 aa, Artificial Sequence
  Description of Artificial Sequence: Synthetic peptide
QQSYSTPRT

SEQ ID NO: 249 - protein, 5 aa, Artificial Sequence
  Description of Artificial Sequence: Synthetic peptide
QQAGI

SEQ ID NO: 250 - protein, 5 aa, Artificial Sequence
  Description of Artificial Sequence: Synthetic peptide
QQAGI

SEQ ID NO: 251 - protein, 5 aa, Artificial Sequence
  Description of Artificial Sequence: Synthetic peptide
QQAGI

SEQ ID NO: 252 - protein, 10 aa, Artificial Sequence
  Description of Artificial Sequence: Synthetic peptide
QQYGTSPPWA

SEQ ID NO: 253 - protein, 5 aa, Artificial Sequence
  Description of Artificial Sequence: Synthetic peptide
QQAGI

SEQ ID NO: 254 - protein, 10 aa, Artificial Sequence
  Description of Artificial Sequence: Synthetic peptide
FGQGTKLEIK

SEQ ID NO: 255 - protein, 10 aa, Artificial Sequence
  Description of Artificial Sequence: Synthetic peptide
FGQGTKLEIK

SEQ ID NO: 256 - protein, 10 aa, Artificial Sequence
  Description of Artificial Sequence: Synthetic peptide
FGQGTKLEIK

SEQ ID NO: 257 - protein, 10 aa, Artificial Sequence
  Description of Artificial Sequence: Synthetic peptide
FGQGTKLEIK

SEQ ID NO: 258 - protein, 10 aa, Artificial Sequence
  Description of Artificial Sequence: Synthetic peptide
FGQGTKLEIK

SEQ ID NO: 259 - protein, 10 aa, Artificial Sequence
  Description of Artificial Sequence: Synthetic peptide
FGQGTKLEIK

SEQ ID NO: 260 - protein, 10 aa, Artificial Sequence
  Description of Artificial Sequence: Synthetic peptide
FGQGTKLEIK

SEQ ID NO: 261 - protein, 10 aa, Artificial Sequence
  Description of Artificial Sequence: Synthetic peptide
FGQGTKLEIK

SEQ ID NO: 262 - protein, 10 aa, Artificial Sequence
  Description of Artificial Sequence: Synthetic peptide
FGQGTKLEIK

SEQ ID NO: 263 - protein, 10 aa, Artificial Sequence
  Description of Artificial Sequence: Synthetic peptide
FGQGTKLEIK

SEQ ID NO: 264 - protein, 10 aa, Artificial Sequence
  Description of Artificial Sequence: Synthetic peptide
FGQGTKLEIK

SEQ ID NO: 265 - protein, 10 aa, Artificial Sequence
  Description of Artificial Sequence: Synthetic peptide
FGQGTKLEIK

SEQ ID NO: 266 - protein, 10 aa, Artificial Sequence
  Description of Artificial Sequence: Synthetic peptide
FGQGTKLEIK

SEQ ID NO: 267 - protein, 10 aa, Artificial Sequence
  Description of Artificial Sequence: Synthetic peptide
FGQGTKLEIK

SEQ ID NO: 268 - protein, 10 aa, Artificial Sequence
  Description of Artificial Sequence: Synthetic peptide
FGQGTKLEIK

SEQ ID NO: 269 - protein, 10 aa, Artificial Sequence
  Description of Artificial Sequence: Synthetic peptide
FGQGTKLEIK

SEQ ID NO: 270 - protein, 10 aa, Artificial Sequence
  Description of Artificial Sequence: Synthetic peptide
FGQGTKLEIK

SEQ ID NO: 271 - protein, 10 aa, Artificial Sequence
  Description of Artificial Sequence: Synthetic peptide
FGQGTKLEIK

SEQ ID NO: 272 - protein, 10 aa, Artificial Sequence
  Description of Artificial Sequence: Synthetic peptide
FGQGTKLEIK

SEQ ID NO: 273 - protein, 10 aa, Artificial Sequence
  Description of Artificial Sequence: Synthetic peptide
FGQGTKLEIK

SEQ ID NO: 274 - protein, 10 aa, Artificial Sequence
  Description of Artificial Sequence: Synthetic peptide
FGQGTKLEIK

SEQ ID NO: 275 - protein, 10 aa, Artificial Sequence
  Description of Artificial Sequence: Synthetic peptide
FGQGTKLEIK

SEQ ID NO: 276 - protein, 10 aa, Artificial Sequence
  Description of Artificial Sequence: Synthetic peptide
FGQGTKLEIK

SEQ ID NO: 277 - protein, 10 aa, Artificial Sequence
  Description of Artificial Sequence: Synthetic peptide
FGQGTKLEIK

SEQ ID NO: 278 - protein, 10 aa, Artificial Sequence
  Description of Artificial Sequence: Synthetic peptide
FGQGTKLEIK

SEQ ID NO: 279 - protein, 10 aa, Artificial Sequence
  Description of Artificial Sequence: Synthetic peptide
FGQGTKLEIK

SEQ ID NO: 280 - protein, 10 aa, Artificial Sequence
  Description of Artificial Sequence: Synthetic peptide
FGQGTKLEIK

SEQ ID NO: 281 - protein, 10 aa, Artificial Sequence
  Description of Artificial Sequence: Synthetic peptide
FGQGTKLEIK

SEQ ID NO: 282 - protein, 10 aa, Artificial Sequence
  Description of Artificial Sequence: Synthetic peptide
FGQGTKVEIK

SEQ ID NO: 283 - protein, 10 aa, Artificial Sequence
  Description of Artificial Sequence: Synthetic peptide
FGQGTKLEIK

SEQ ID NO: 284 - protein, 10 aa, Artificial Sequence
  Description of Artificial Sequence: Synthetic peptide
FGQGTKLEIK

SEQ ID NO: 285 - protein, 10 aa, Artificial Sequence
  Description of Artificial Sequence: Synthetic peptide
FGQGTKLEIK

SEQ ID NO: 286 - protein, 10 aa, Artificial Sequence
  Description of Artificial Sequence: Synthetic peptide
FGQGTKVEIK

SEQ ID NO: 287 - protein, 10 aa, Artificial Sequence
  Description of Artificial Sequence: Synthetic peptide
FGQGTKLEIK

SEQ ID NO: 288 - protein, 7 aa, Artificial Sequence
  Description of Artificial Sequence: Synthetic peptide
RTVAAPS

SEQ ID NO: 289 - protein, 7 aa, Artificial Sequence
  Description of Artificial Sequence: Synthetic peptide
RTVAAPS

SEQ ID NO: 290 - protein, 7 aa, Artificial Sequence
  Description of Artificial Sequence: Synthetic peptide
RTVAAPS

SEQ ID NO: 291 - protein, 7 aa, Artificial Sequence
  Description of Artificial Sequence: Synthetic peptide
RTVAAPS

SEQ ID NO: 292 - protein, 7 aa, Artificial Sequence
  Description of Artificial Sequence: Synthetic peptide
RTVAAPS

SEQ ID NO: 293 - protein, 7 aa, Artificial Sequence
  Description of Artificial Sequence: Synthetic peptide
RTVAAPS

SEQ ID NO: 294 - protein, 7 aa, Artificial Sequence
  Description of Artificial Sequence: Synthetic peptide
RTVAAPS

SEQ ID NO: 295 - protein, 7 aa, Artificial Sequence
  Description of Artificial Sequence: Synthetic peptide
RTVAAPS

SEQ ID NO: 296 - protein, 7 aa, Artificial Sequence
  Description of Artificial Sequence: Synthetic peptide
RTVAAPS

SEQ ID NO: 297 - protein, 7 aa, Artificial Sequence
  Description of Artificial Sequence: Synthetic peptide
RTVAAPS

SEQ ID NO: 298 - protein, 7 aa, Artificial Sequence
  Description of Artificial Sequence: Synthetic peptide
RTVAAPS

SEQ ID NO: 299 - protein, 7 aa, Artificial Sequence
  Description of Artificial Sequence: Synthetic peptide
RTVAAPS

SEQ ID NO: 300 - protein, 7 aa, Artificial Sequence
  Description of Artificial Sequence: Synthetic peptide
RTVAAPS

SEQ ID NO: 301 - protein, 7 aa, Artificial Sequence
  Description of Artificial Sequence: Synthetic peptide
RTVAAPS

SEQ ID NO: 302 - protein, 7 aa, Artificial Sequence
  Description of Artificial Sequence: Synthetic peptide
RTVAAPS

SEQ ID NO: 303 - protein, 7 aa, Artificial Sequence
  Description of Artificial Sequence: Synthetic peptide
RTVAAPS

SEQ ID NO: 304 - protein, 7 aa, Artificial Sequence
  Description of Artificial Sequence: Synthetic peptide
RTVAAPS

SEQ ID NO: 305 - protein, 7 aa, Artificial Sequence
  Description of Artificial Sequence: Synthetic peptide
RTVAAPS

SEQ ID NO: 306 - protein, 7 aa, Artificial Sequence
  Description of Artificial Sequence: Synthetic peptide
RTVAAPS

SEQ ID NO: 307 - protein, 7 aa, Artificial Sequence
  Description of Artificial Sequence: Synthetic peptide
RTVAAPS

SEQ ID NO: 308 - protein, 7 aa, Artificial Sequence
  Description of Artificial Sequence: Synthetic peptide
RTVAAPS

SEQ ID NO: 309 - protein, 7 aa, Artificial Sequence
  Description of Artificial Sequence: Synthetic peptide
RTVAAPS

SEQ ID NO: 310 - protein, 7 aa, Artificial Sequence
  Description of Artificial Sequence: Synthetic peptide
RTVAAPS

SEQ ID NO: 311 - protein, 7 aa, Artificial Sequence
  Description of Artificial Sequence: Synthetic peptide
RTVAAPS

SEQ ID NO: 312 - protein, 7 aa, Artificial Sequence
  Description of Artificial Sequence: Synthetic peptide
RTVAAPS

SEQ ID NO: 313 - protein, 7 aa, Artificial Sequence
  Description of Artificial Sequence: Synthetic peptide
RTVAAPS

SEQ ID NO: 314 - protein, 7 aa, Artificial Sequence
  Description of Artificial Sequence: Synthetic peptide
RTVAAPS

SEQ ID NO: 315 - protein, 7 aa, Artificial Sequence
  Description of Artificial Sequence: Synthetic peptide
RTVAAPS

SEQ ID NO: 316 - protein, 7 aa, Artificial Sequence
  Description of Artificial Sequence: Synthetic peptide
RTVAAPS

SEQ ID NO: 317 - protein, 7 aa, Artificial Sequence
  Description of Artificial Sequence: Synthetic peptide
RTVAAPS

SEQ ID NO: 318 - protein, 7 aa, Artificial Sequence
  Description of Artificial Sequence: Synthetic peptide
RTVAAPS

SEQ ID NO: 319 - protein, 7 aa, Artificial Sequence
  Description of Artificial Sequence: Synthetic peptide
RTVAAPS

SEQ ID NO: 320 - protein, 7 aa, Artificial Sequence
  Description of Artificial Sequence: Synthetic peptide
RTVAAPS

SEQ ID NO: 321 - protein, 7 aa, Artificial Sequence
  Description of Artificial Sequence: Synthetic peptide
RTVAAPS

SEQ ID NO: 322 - protein, 30 aa, Artificial Sequence
  Description of Artificial Sequence: Synthetic polypeptide
EVQLLESGGGLVQPGGSLRLSCAASGFTFS

SEQ ID NO: 323 - protein, 30 aa, Artificial Sequence; identical to SEQ ID NO: 322
  Description of Artificial Sequence: Synthetic polypeptide

SEQ ID NO: 324 - protein, 30 aa, Artificial Sequence; identical to SEQ ID NO: 322
  Description of Artificial Sequence: Synthetic polypeptide

SEQ ID NO: 325 - protein, 30 aa, Artificial Sequence; identical to SEQ ID NO: 322
  Description of Artificial Sequence: Synthetic polypeptide

SEQ ID NO: 326 - protein, 30 aa, Artificial Sequence; identical to SEQ ID NO: 322
  Description of Artificial Sequence: Synthetic polypeptide

SEQ ID NO: 327 - protein, 30 aa, Artificial Sequence; identical to SEQ ID NO: 322
  Description of Artificial Sequence: Synthetic polypeptide

SEQ ID NO: 328 - protein, 30 aa, Artificial Sequence; identical to SEQ ID NO: 322
  Description of Artificial Sequence: Synthetic polypeptide

SEQ ID NO: 329 - protein, 30 aa, Artificial Sequence; identical to SEQ ID NO: 322
  Description of Artificial Sequence: Synthetic polypeptide

SEQ ID NO: 330 - protein, 30 aa, Artificial Sequence; identical to SEQ ID NO: 322
  Description of Artificial Sequence: Synthetic polypeptide

SEQ ID NO: 331 - protein, 30 aa, Artificial Sequence; identical to SEQ ID NO: 322
  Description of Artificial Sequence: Synthetic polypeptide

SEQ ID NO: 332 - protein, 30 aa, Artificial Sequence; identical to SEQ ID NO: 322
  Description of Artificial Sequence: Synthetic polypeptide

SEQ ID NO: 333 - protein, 30 aa, Artificial Sequence; identical to SEQ ID NO: 322
  Description of Artificial Sequence: Synthetic polypeptide

SEQ ID NO: 334 - protein, 30 aa, Artificial Sequence; identical to SEQ ID NO: 322
  Description of Artificial Sequence: Synthetic polypeptide

SEQ ID NO: 335 - protein, 30 aa, Artificial Sequence; identical to SEQ ID NO: 322
  Description of Artificial Sequence: Synthetic polypeptide

SEQ ID NO: 336 - protein, 30 aa, Artificial Sequence; identical to SEQ ID NO: 322
  Description of Artificial Sequence: Synthetic polypeptide

SEQ ID NO: 337 - protein, 30 aa, Artificial Sequence; identical to SEQ ID NO: 322
  Description of Artificial Sequence: Synthetic polypeptide

SEQ ID NO: 338 - protein, 30 aa, Artificial Sequence; identical to SEQ ID NO: 322
  Description of Artificial Sequence: Synthetic polypeptide

SEQ ID NO: 339 - protein, 30 aa, Artificial Sequence; identical to SEQ ID NO: 322
  Description of Artificial Sequence: Synthetic polypeptide

SEQ ID NO: 340 - protein, 30 aa, Artificial Sequence; identical to SEQ ID NO: 322
  Description of Artificial Sequence: Synthetic polypeptide

SEQ ID NO: 341 - protein, 30 aa, Artificial Sequence; identical to SEQ ID NO: 322
  Description of Artificial Sequence: Synthetic polypeptide

SEQ ID NO: 342 - protein, 30 aa, Artificial Sequence; identical to SEQ ID NO: 322
  Description of Artificial Sequence: Synthetic polypeptide

SEQ ID NO: 343 - protein, 30 aa, Artificial Sequence; identical to SEQ ID NO: 322
  Description of Artificial Sequence: Synthetic polypeptide

SEQ ID NO: 344 - protein, 30 aa, Artificial Sequence; identical to SEQ ID NO: 322
  Description of Artificial Sequence: Synthetic polypeptide

SEQ ID NO: 345 - protein, 30 aa, Artificial Sequence; identical to SEQ ID NO: 322
  Description of Artificial Sequence: Synthetic polypeptide

SEQ ID NO: 346 - protein, 30 aa, Artificial Sequence; identical to SEQ ID NO: 322
  Description of Artificial Sequence: Synthetic polypeptide

SEQ ID NO: 347 - protein, 30 aa, Artificial Sequence; identical to SEQ ID NO: 322
  Description of Artificial Sequence: Synthetic polypeptide

SEQ ID NO: 348 - protein, 30 aa, Artificial Sequence; identical to SEQ ID NO: 322
  Description of Artificial Sequence: Synthetic polypeptide

SEQ ID NO: 349 - protein, 30 aa, Artificial Sequence; identical to SEQ ID NO: 322
  Description of Artificial Sequence: Synthetic polypeptide

SEQ ID NO: 350 - protein, 30 aa, Artificial Sequence; identical to SEQ ID NO: 322
  Description of Artificial Sequence: Synthetic polypeptide

SEQ ID NO: 351 - protein, 30 aa, Artificial Sequence; identical to SEQ ID NO: 322
  Description of Artificial Sequence: Synthetic polypeptide

SEQ ID NO: 352 - protein, 30 aa, Artificial Sequence; identical to SEQ ID NO: 322
  Description of Artificial Sequence: Synthetic polypeptide

SEQ ID NO: 353 - protein, 30 aa, Artificial Sequence; identical to SEQ ID NO: 322
  Description of Artificial Sequence: Synthetic polypeptide

SEQ ID NO: 354 - protein, 30 aa, Artificial Sequence; identical to SEQ ID NO: 322
  Description of Artificial Sequence: Synthetic polypeptide

SEQ ID NO: 355 - protein, 30 aa, Artificial Sequence; identical to SEQ ID NO: 322
  Description of Artificial Sequence: Synthetic peptide

SEQ ID NO: 356 - protein, 5 aa, Artificial Sequence
  Description of Artificial Sequence: Synthetic peptide
QYWMG

SEQ ID NO: 357 - protein, 5 aa, Artificial Sequence
  Description of Artificial Sequence: Synthetic peptide
DYGMA

SEQ ID NO: 358 - protein, 5 aa, Artificial Sequence
  Description of Artificial Sequence: Synthetic peptide
WYWMG

SEQ ID NO: 359 - protein, 5 aa, Artificial Sequence
  Description of Artificial Sequence: Synthetic peptide
PYWMH

SEQ ID NO: 360 - protein, 5 aa, Artificial Sequence
  Description of Artificial Sequence: Synthetic peptide
PYWMS

SEQ ID NO: 361 - protein, 5 aa, Artificial Sequence
  Description of Artificial Sequence: Synthetic peptide
WYWMV

SEQ ID NO: 362 - protein, 5 aa, Artificial Sequence
  Description of Artificial Sequence: Synthetic peptide
WYNMH

SEQ ID NO: 363 - protein, 5 aa, Artificial Sequence
  Description of Artificial Sequence: Synthetic peptide
WYGMG

SEQ ID NO: 364 - protein, 5 aa, Artificial Sequence
  Description of Artificial Sequence: Synthetic peptide
YYGMG

SEQ ID NO: 365 - protein, 5 aa, Artificial Sequence
  Description of Artificial Sequence: Synthetic peptide
QYWMS

SEQ ID NO: 366 - protein, 5 aa, Artificial Sequence
  Description of Artificial Sequence: Synthetic peptide
WYWMH

SEQ ID NO: 367 - protein, 5 aa, Artificial Sequence
  Description of Artificial Sequence: Synthetic peptide
RYNMH

SEQ ID NO: 368 - protein, 5 aa, Artificial Sequence
  Description of Artificial Sequence: Synthetic peptide
VYGMS

SEQ ID NO: 369 - protein, 5 aa, Artificial Sequence
  Description of Artificial Sequence: Synthetic peptide
EYWMA

SEQ ID NO: 370 - protein, 5 aa, Artificial Sequence
  Description of Artificial Sequence: Synthetic peptide
WYNMS

SEQ ID NO: 371 - protein, 5 aa, Artificial Sequence
  Description of Artificial Sequence: Synthetic peptide
EYWMG

SEQ ID NO: 372 - protein, 5 aa, Artificial Sequence
  Description of Artificial Sequence: Synthetic peptide
YYNMS

SEQ ID NO: 373 - protein, 5 aa, Artificial Sequence
  Description of Artificial Sequence: Synthetic peptide
YYNMH

SEQ ID NO: 374 - protein, 5 aa, Artificial Sequence
  Description of Artificial Sequence: Synthetic peptide
LYHMH

SEQ ID NO: 375 - protein, 5 aa, Artificial Sequence
  Description of Artificial Sequence: Synthetic peptide
EYNMH

SEQ ID NO: 376 - protein, 5 aa, Artificial Sequence
  Description of Artificial Sequence: Synthetic peptide
EYWMT

SEQ ID NO: 377 - protein, 5 aa, Artificial Sequence
  Description of Artificial Sequence: Synthetic peptide
HYWMH

SEQ ID NO: 378 - protein, 5 aa, Artificial Sequence
  Description of Artificial Sequence: Synthetic peptide
QYNMH

SEQ ID NO: 379 - protein, 5 aa, Artificial Sequence
  Description of Artificial Sequence: Synthetic peptide
PYWMH

SEQ ID NO: 380 - protein, 5 aa, Artificial Sequence
  Description of Artificial Sequence: Synthetic peptide
PYWMH

SEQ ID NO: 381 - protein, 5 aa, Artificial Sequence
  Description of Artificial Sequence: Synthetic peptide
AYGMS

SEQ ID NO: 382 - protein, 5 aa, Artificial Sequence
  Description of Artificial Sequence: Synthetic peptide
WYYMG

SEQ ID NO: 383 - protein, 5 aa, Artificial Sequence
  Description of Artificial Sequence: Synthetic peptide
FYWMD

SEQ ID NO: 384 - protein, 5 aa, Artificial Sequence
  Description of Artificial Sequence: Synthetic peptide
DYNMH

SEQ ID NO: 385 - protein, 5 aa, Artificial Sequence
  Description of Artificial Sequence: Synthetic peptide
WYWMV

SEQ ID NO: 386 - protein, 5 aa, Artificial Sequence
  Description of Artificial Sequence: Synthetic peptide
RYMMH

SEQ ID NO: 387 - protein, 5 aa, Artificial Sequence
  Description of Artificial Sequence: Synthetic peptide
HYWMQ

SEQ ID NO: 388 - protein, 5 aa, Artificial Sequence
  Description of Artificial Sequence: Synthetic peptide
DYNMH

SEQ ID NO: 389 - protein, 5 aa, Artificial Sequence
  Description of Artificial Sequence: Synthetic peptide
DYWMA

SEQ ID NO: 390 - protein, 14 aa, Artificial Sequence
  Description of Artificial Sequence: Synthetic peptide
WVRQAPGKGLEWVS

SEQ ID NO: 391 - protein, 14 aa, Artificial Sequence
  Description of Artificial Sequence: Synthetic peptide
WVRQAPGKGLEWVS

SEQ ID NO: 392 - protein, 14 aa, Artificial Sequence
  Description of Artificial Sequence: Synthetic peptide
WVRQAPGKGLEWVS

SEQ ID NO: 393 - protein, 14 aa, Artificial Sequence
  Description of Artificial Sequence: Synthetic peptide
WVRQAPGKGLEWVS

SEQ ID NO: 394 - protein, 14 aa, Artificial Sequence
  Description of Artificial Sequence: Synthetic peptide
WVRQAPGKGLEWVS

SEQ ID NO: 395 - protein, 14 aa, Artificial Sequence
  Description of Artificial Sequence: Synthetic peptide
WVRQAPGKGLEWVS

SEQ ID NO: 396 - protein, 14 aa, Artificial Sequence
  Description of Artificial Sequence: Synthetic peptide
WVRQAPGKGLEWVS

SEQ ID NO: 397 - protein, 14 aa, Artificial Sequence
  Description of Artificial Sequence: Synthetic peptide
WVRQAPGKGLEWVS

SEQ ID NO: 398 - protein, 14 aa, Artificial Sequence
  Description of Artificial Sequence: Synthetic peptide
WVRQAPGKGLEWVS

SEQ ID NO: 399 - protein, 14 aa, Artificial Sequence
  Description of Artificial Sequence: Synthetic peptide
WVRQAPGKGLEWVS

SEQ ID NO: 400 - protein, 14 aa, Artificial Sequence
  Description of Artificial Sequence: Synthetic peptide
WVRQAPGKGLEWVS

SEQ ID NO: 401 - protein, 14 aa, Artificial Sequence
  Description of Artificial Sequence: Synthetic peptide
WVRQAPGKGLEWVS

SEQ ID NO: 402 - protein, 14 aa, Artificial Sequence
  Description of Artificial Sequence: Synthetic peptide
WVRQAPGKGLEWVS

SEQ ID NO: 403 - protein, 14 aa, Artificial Sequence
  Description of Artificial Sequence: Synthetic peptide
WVRQAPGKGLEWVS

SEQ ID NO: 404 - protein, 14 aa, Artificial Sequence
  Description of Artificial Sequence: Synthetic peptide
WVRQAPGKGLEWVS

SEQ ID NO: 405 - protein, 14 aa, Artificial Sequence
  Description of Artificial Sequence: Synthetic peptide
WVRQAPGKGLEWVS

SEQ ID NO: 406 - protein, 14 aa, Artificial Sequence
  Description of Artificial Sequence: Synthetic peptide
WVRQAPGKGLEWVS

SEQ ID NO: 407 - protein, 14 aa, Artificial Sequence
  Description of Artificial Sequence: Synthetic peptide
WVRQAPGKGLEWVS

SEQ ID NO: 408 - protein, 14 aa, Artificial Sequence
  Description of Artificial Sequence: Synthetic peptide
WVRQAPGKGLEWVS

SEQ ID NO: 409 - protein, 14 aa, Artificial Sequence
  Description of Artificial Sequence: Synthetic peptide
WVRQAPGKGLEWVS

SEQ ID NO: 410 - protein, 14 aa, Artificial Sequence
  Description of Artificial Sequence: Synthetic peptide
WVRQAPGKGLEWVS

SEQ ID NO: 411 - protein, 14 aa, Artificial Sequence
  Description of Artificial Sequence: Synthetic peptide
WVRQAPGKGLEWVS

SEQ ID NO: 412 - protein, 14 aa, Artificial Sequence
  Description of Artificial Sequence: Synthetic peptide
WVRQAPGKGLEWVS

SEQ ID NO: 413 - protein, 14 aa, Artificial Sequence
  Description of Artificial Sequence: Synthetic peptide
WVRQAPGKGLEWVS

SEQ ID NO: 414 - protein, 14 aa, Artificial Sequence
  Description of Artificial Sequence: Synthetic peptide
WVRQAPGKGLEWVS

SEQ ID NO: 415 - protein, 14 aa, Artificial Sequence
  Description of Artificial Sequence: Synthetic peptide
WVRQAPGKGLEWVS

SEQ ID NO: 416 - protein, 14 aa, Artificial Sequence
  Description of Artificial Sequence: Synthetic peptide
WVRQAPGKGLEWVS

SEQ ID NO: 417 - protein, 14 aa, Artificial Sequence
  Description of Artificial Sequence: Synthetic peptide
WVRQAPGKGLEWVS

SEQ ID NO: 418 - protein, 14 aa, Artificial Sequence
  Description of Artificial Sequence: Synthetic peptide
WVRQAPGKGLEWVS

SEQ ID NO: 419 - protein, 14 aa, Artificial Sequence
  Description of Artificial Sequence: Synthetic peptide
WVRQAPGKGLEWVS

SEQ ID NO: 420 - protein, 14 aa, Artificial Sequence
  Description of Artificial Sequence: Synthetic peptide
WVRQAPGKGLEWVS

SEQ ID NO: 421 - protein, 14 aa, Artificial Sequence
  Description of Artificial Sequence: Synthetic peptide
WVRQAPGKGLEWVS

SEQ ID NO: 422 - protein, 14 aa, Artificial Sequence
  Description of Artificial Sequence: Synthetic peptide
WVRQAPGKGLEWVS

SEQ ID NO: 423 - protein, 14 aa, Artificial Sequence
  Description of Artificial Sequence: Synthetic peptide
WVRQAPGKGLEWVS

SEQ ID NO: 424 - protein, 17 aa, Artificial Sequence
  Description of Artificial Sequence: Synthetic peptide
SISPSGGMTMYADSVKG

SEQ ID NO: 425 - protein, 17 aa, Artificial Sequence
  Description of Artificial Sequence: Synthetic peptide
SISPSGGWTLYADSVKG

SEQ ID NO: 426 - protein, 17 aa, Artificial Sequence
  Description of Artificial Sequence: Synthetic peptide
SISPSGGYTFYADSVKG

SEQ ID NO: 427 - protein, 17 aa, Artificial Sequence
  Description of Artificial Sequence: Synthetic peptide
GIGPSGGLTFYADSVKG

SEQ ID NO: 428 - protein, 17 aa, Artificial Sequence
  Description of Artificial Sequence: Synthetic peptide
GISPSGGITFYADSVKG

SEQ ID NO: 429 - protein, 17 aa, Artificial Sequence
  Description of Artificial Sequence: Synthetic peptide
SIGPSGGDTYYADSVKG

SEQ ID NO: 430 - protein, 17 aa, Artificial Sequence
  Description of Artificial Sequence: Synthetic peptide
GISPSGGNTMYADSVKG

SEQ ID NO: 431 - protein, 17 aa, Artificial Sequence
  Description of Artificial Sequence: Synthetic peptide
VIVSSGGFTQYADSVKG

SEQ ID NO: 432 - protein, 17 aa, Artificial Sequence
  Description of Artificial Sequence: Synthetic peptide
VISSSGGFTFYADSVKG

SEQ ID NO: 433 - protein, 17 aa, Artificial Sequence
  Description of Artificial Sequence: Synthetic peptide
SISPSGGETFYADSVKG

SEQ ID NO: 434 - protein, 17 aa, Artificial Sequence
  Description of Artificial Sequence: Synthetic peptide
GIVSSGGTTIYADSVKG

SEQ ID NO: 435 - protein, 17 aa, Artificial Sequence
  Description of Artificial Sequence: Synthetic peptide
GIVPSGGTTHYADSVKG

SEQ ID NO: 436 - protein, 17 aa, Artificial Sequence
  Description of Artificial Sequence: Synthetic peptide
RIVPSGGRTGYADSVKG

SEQ ID NO: 437 - protein, 17 aa, Artificial Sequence
  Description of Artificial Sequence: Synthetic peptide
SISPSGGHTFYADSVKG

SEQ ID NO: 438 - protein, 17 aa, Artificial Sequence
  Description of Artificial Sequence: Synthetic peptide
RISPSGGDTGYADSVKG

SEQ ID NO: 439 - protein, 17 aa, Artificial Sequence
  Description of Artificial Sequence: Synthetic peptide
SIYPSGGNTIYADSVKG

SEQ ID NO: 440 - protein, 17 aa, Artificial Sequence
  Description of Artificial Sequence: Synthetic peptide
GISPSGGPTGYADSVKG

SEQ ID NO: 441 - protein, 17 aa, Artificial Sequence
  Description of Artificial Sequence: Synthetic peptide
GIGPSGGGTLYADSVKG

SEQ ID NO: 442 - protein, 17 aa, Artificial Sequence
  Description of Artificial Sequence: Synthetic peptide
GIGPSGGWTIYADSVKG

SEQ ID NO: 443 - protein, 17 aa, Artificial Sequence
  Description of Artificial Sequence: Synthetic peptide
GISPSGGMTHYADSVKG

SEQ ID NO: 444 - protein, 17 aa, Artificial Sequence
  Description of Artificial Sequence: Synthetic peptide
GISPSGGMTFYADSVKG

SEQ ID NO: 445 - protein, 17 aa, Artificial Sequence
  Description of Artificial Sequence: Synthetic peptide
GISPSGGMTMYADSVKG

SEQ ID NO: 446 - protein, 17 aa, Artificial Sequence
  Description of Artificial Sequence: Synthetic peptide
GIGPSGGITIYADSVKG

SEQ ID NO: 447 - protein, 17 aa, Artificial Sequence
  Description of Artificial Sequence: Synthetic peptide
GISSSGGDTLYADSVKG

SEQ ID NO: 448 - protein, 17 aa, Artificial Sequence
  Description of Artificial Sequence: Synthetic peptide
GIGPSGGPTFYADSIKG

SEQ ID NO: 449 - protein, 17 aa, Artificial Sequence
  Description of Artificial Sequence: Synthetic peptide
RISPSGGITGYADSVKG

SEQ ID NO: 450 - protein, 17 aa, Artificial Sequence
  Description of Artificial Sequence: Synthetic peptide
SISPSGGWTRYADSVKG

SEQ ID NO: 451 - protein, 17 aa, Artificial Sequence
  Description of Artificial Sequence: Synthetic peptide
SISPSGGTTIYADSVKG

SEQ ID NO: 452 - protein, 17 aa, Artificial Sequence
  Description of Artificial Sequence: Synthetic peptide
YIGPSGGYTHYADSVKG

SEQ ID NO: 453 - protein, 17 aa, Artificial Sequence
  Description of Artificial Sequence: Synthetic peptide
SIVPSGGFTIYADSVKG

SEQ ID NO: 454 - protein, 17 aa, Artificial Sequence
  Description of Artificial Sequence: Synthetic peptide
YISSSGGTTIYADSVKG

SEQ ID NO: 455 - protein, 17 aa, Artificial Sequence
  Description of Artificial Sequence: Synthetic peptide
GIVPSGGLTMYADSVKG

SEQ ID NO: 456 - protein, 17 aa, Artificial Sequence
  Description of Artificial Sequence: Synthetic peptide
YIGPSGGYTHYADSVKG

SEQ ID NO: 457 - protein, 17 aa, Artificial Sequence
  Description of Artificial Sequence: Synthetic peptide
SIGPSGGFTVYADSVKG

SEQ ID NO: 458 - protein, 32 aa, Artificial Sequence
  Description of Artificial Sequence: Synthetic polypeptide
RFTISRDNSKNTLYLQMNSLRAEDTAVYYCAK

SEQ ID NO: 459 - protein, 32 aa, Artificial Sequence; identical to SEQ ID NO: 458
  Description of Artificial Sequence: Synthetic polypeptide

SEQ ID NO: 460 - protein, 32 aa, Artificial Sequence; identical to SEQ ID NO: 458
  Description of Artificial Sequence: Synthetic polypeptide

SEQ ID NO: 461 - protein, 32 aa, Artificial Sequence; identical to SEQ ID NO: 458
  Description of Artificial Sequence: Synthetic polypeptide

SEQ ID NO: 462 - protein, 32 aa, Artificial Sequence; identical to SEQ ID NO: 458
  Description of Artificial Sequence: Synthetic polypeptide

SEQ ID NO: 463 - protein, 32 aa, Artificial Sequence; identical to SEQ ID NO: 458
  Description of Artificial Sequence: Synthetic polypeptide

SEQ ID NO: 464 - protein, 32 aa, Artificial Sequence; identical to SEQ ID NO: 458
  Description of Artificial Sequence: Synthetic polypeptide

SEQ ID NO: 465 - protein, 32 aa, Artificial Sequence; identical to SEQ ID NO: 458
  Description of Artificial Sequence: Synthetic polypeptide

SEQ ID NO: 466 - protein, 32 aa, Artificial Sequence; identical to SEQ ID NO: 458
  Description of Artificial Sequence: Synthetic polypeptide

SEQ ID NO: 467 - protein, 32 aa, Artificial Sequence; identical to SEQ ID NO: 458
  Description of Artificial Sequence: Synthetic polypeptide

SEQ ID NO: 468 - protein, 32 aa, Artificial Sequence; identical to SEQ ID NO: 458
  Description of Artificial Sequence: Synthetic polypeptide

SEQ ID NO: 469 - protein, 32 aa, Artificial Sequence; identical to SEQ ID NO: 458
  Description of Artificial Sequence: Synthetic polypeptide

SEQ ID NO: 470 - protein, 32 aa, Artificial Sequence; identical to SEQ ID NO: 458
  Description of Artificial Sequence: Synthetic polypeptide

SEQ ID NO: 471 - protein, 32 aa, Artificial Sequence; identical to SEQ ID NO: 458
  Description of Artificial Sequence: Synthetic polypeptide

SEQ ID NO: 472 - protein, 32 aa, Artificial Sequence; identical to SEQ ID NO: 458
  Description of Artificial Sequence: Synthetic polypeptide

SEQ ID NO: 473 - protein, 32 aa, Artificial Sequence; identical to SEQ ID NO: 458
  Description of Artificial Sequence: Synthetic polypeptide

SEQ ID NO: 474 - protein, 32 aa, Artificial Sequence; identical to SEQ ID NO: 458
  Description of Artificial Sequence: Synthetic polypeptide

SEQ ID NO: 475 - protein, 32 aa, Artificial Sequence; identical to SEQ ID NO: 458
  Description of Artificial Sequence: Synthetic polypeptide

SEQ ID NO: 476 - protein, 32 aa, Artificial Sequence; identical to SEQ ID NO: 458
  Description of Artificial Sequence: Synthetic polypeptide

SEQ ID NO: 477 - protein, 32 aa, Artificial Sequence; identical to SEQ ID NO: 458
  Description of Artificial Sequence: Synthetic polypeptide

SEQ ID NO: 478 - protein, 32 aa, Artificial Sequence; identical to SEQ ID NO: 458
  Description of Artificial Sequence: Synthetic polypeptide

SEQ ID NO: 479 - protein, 32 aa, Artificial Sequence; identical to SEQ ID NO: 458
  Description of Artificial Sequence: Synthetic polypeptide

SEQ ID NO: 480 - protein, 32 aa, Artificial Sequence; identical to SEQ ID NO: 458
  Description of Artificial Sequence: Synthetic polypeptide

SEQ ID NO: 481 - protein, 32 aa, Artificial Sequence; identical to SEQ ID NO: 458
  Description of Artificial Sequence: Synthetic polypeptide

SEQ ID NO: 482 - protein, 32 aa, Artificial Sequence; identical to SEQ ID NO: 458
  Description of Artificial Sequence: Synthetic polypeptide

SEQ ID NO: 483 - protein, 32 aa, Artificial Sequence; identical to SEQ ID NO: 458
  Description of Artificial Sequence: Synthetic polypeptide

SEQ ID NO: 484 - protein, 32 aa, Artificial Sequence; identical to SEQ ID NO: 458
  Description of Artificial Sequence: Synthetic polypeptide

SEQ ID NO: 485 - protein, 32 aa, Artificial Sequence; identical to SEQ ID NO: 458
  Description of Artificial Sequence: Synthetic polypeptide

SEQ ID NO: 486 - protein, 32 aa, Artificial Sequence; identical to SEQ ID NO: 458
  Description of Artificial Sequence: Synthetic polypeptide

SEQ ID NO: 487 - protein, 32 aa, Artificial Sequence; identical to SEQ ID NO: 458
  Description of Artificial Sequence: Synthetic polypeptide

SEQ ID NO: 488 - protein, 32 aa, Artificial Sequence; identical to SEQ ID NO: 458
  Description of Artificial Sequence: Synthetic polypeptide

SEQ ID NO: 489 - protein, 32 aa, Artificial Sequence; identical to SEQ ID NO: 458
  Description of Artificial Sequence: Synthetic polypeptide

SEQ ID NO: 490 - protein, 32 aa, Artificial Sequence; identical to SEQ ID NO: 458
  Description of Artificial Sequence: Synthetic polypeptide

SEQ ID NO: 491 - protein, 32 aa, Artificial Sequence; identical to SEQ ID NO: 458
  Description of Artificial Sequence: Synthetic polypeptide

SEQ ID NO: 492 - protein, 13 aa, Artificial Sequence
  Description of Artificial Sequence: Synthetic peptide
DIRGAYSSGLFDY

SEQ ID NO: 493 - protein, 13 aa, Artificial Sequence
  Description of Artificial Sequence: Synthetic peptide
DIRGAYSSGLFDY

SEQ ID NO: 494 - protein, 13 aa, Artificial Sequence
  Description of Artificial Sequence: Synthetic peptide
DIRGAYSSGLFDY

SEQ ID NO: 495 - protein, 13 aa, Artificial Sequence
  Description of Artificial Sequence: Synthetic peptide
DIRGAYSSGLFDY

SEQ ID NO: 496 - protein, 13 aa, Artificial Sequence
  Description of Artificial Sequence: Synthetic peptide
DIRGAYSSGLFDY

SEQ ID NO: 497 - protein, 13 aa, Artificial Sequence
  Description of Artificial Sequence: Synthetic peptide
DIRGAYSSGLFDY

SEQ ID NO: 498 - protein, 13 aa, Artificial Sequence
  Description of Artificial Sequence: Synthetic peptide
DIRGAYSSGLFDY

SEQ ID NO: 499 - protein, 13 aa, Artificial Sequence
  Description of Artificial Sequence: Synthetic peptide
DIRGAYSSGLFDY

SEQ ID NO: 500 - protein, 13 aa, Artificial Sequence
  Description of Artificial Sequence: Synthetic peptide
DIRGAYSSGLFDY

SEQ ID NO: 501 - protein, 13 aa, Artificial Sequence
  Description of Artificial Sequence: Synthetic peptide
DIRGAYSSGLFDY

SEQ ID NO: 502 - protein, 13 aa, Artificial Sequence
  Description of Artificial Sequence: Synthetic peptide
DIRGAYSSGLFDY

SEQ ID NO: 503 - protein, 13 aa, Artificial Sequence
  Description of Artificial Sequence: Synthetic peptide
DIRGAYSSGLFDY

SEQ ID NO: 504 - protein, 13 aa, Artificial Sequence
  Description of Artificial Sequence: Synthetic peptide
DIRGAYSSGLFDY

SEQ ID NO: 505 - protein, 13 aa, Artificial Sequence
  Description of Artificial Sequence: Synthetic peptide
DIRGAYSSGLFDY

SEQ ID NO: 506 - protein, 13 aa, Artificial Sequence
  Description of Artificial Sequence: Synthetic peptide
DIRGAYSSGLFDY

SEQ ID NO: 507 - protein, 13 aa, Artificial Sequence
  Description of Artificial Sequence: Synthetic peptide
DIRGAYSSGLFDY

SEQ ID NO: 508 - protein, 13 aa, Artificial Sequence
  Description of Artificial Sequence: Synthetic peptide
DIRGAYSSGLFDY

SEQ ID NO: 509 - protein, 13 aa, Artificial Sequence
  Description of Artificial Sequence: Synthetic peptide
DIRGAYSSGLFDY

SEQ ID NO: 510 - protein, 13 aa, Artificial Sequence
  Description of Artificial Sequence: Synthetic peptide
DIRGAYSSGLFDY

SEQ ID NO: 511 - protein, 13 aa, Artificial Sequence
  Description of Artificial Sequence: Synthetic peptide
DIRGAYSSGLFDY

SEQ ID NO: 512 - protein, 13 aa, Artificial Sequence
  Description of Artificial Sequence: Synthetic peptide
DIRGAYSSGLFDY

SEQ ID NO: 513 - protein, 13 aa, Artificial Sequence
  Description of Artificial Sequence: Synthetic peptide
DIRGAYSSGLFDY

SEQ ID NO: 514 - protein, 13 aa, Artificial Sequence
  Description of Artificial Sequence: Synthetic peptide
DIRGAYSSGLFDY

SEQ ID NO: 515 - protein, 13 aa, Artificial Sequence
  Description of Artificial Sequence: Synthetic peptide
DIRGAYSSGLFDY

SEQ ID NO: 516 - protein, 13 aa, Artificial Sequence
  Description of Artificial Sequence: Synthetic peptide
DIRGAYSSGLFDY

SEQ ID NO: 517 - protein, 13 aa, Artificial Sequence
  Description of Artificial Sequence: Synthetic peptide
DIRGAYSSGLFDY

SEQ ID NO: 518 - protein, 13 aa, Artificial Sequence
  Description of Artificial Sequence: Synthetic peptide
DIRGAYSSGLFDY

SEQ ID NO: 519 - protein, 13 aa, Artificial Sequence
  Description of Artificial Sequence: Synthetic peptide
DIRGAYSSGLFDY

SEQ ID NO: 520 - protein, 13 aa, Artificial Sequence
  Description of Artificial Sequence: Synthetic peptide
DIRGAYSSGLFDY

SEQ ID NO: 521 - protein, 13 aa, Artificial Sequence
  Description of Artificial Sequence: Synthetic peptide
DIRGAYSSGLFDY

SEQ ID NO: 522 - protein, 13 aa, Artificial Sequence
  Description of Artificial Sequence: Synthetic peptide
DIRGAYSSGLFDY

SEQ ID NO: 523 - protein, 13 aa, Artificial Sequence
  Description of Artificial Sequence: Synthetic peptide
DIRGAYSSGLFDY

SEQ ID NO: 524 - protein, 13 aa, Artificial Sequence
  Description of Artificial Sequence: Synthetic peptide
DIRGAYSSGLFDY

SEQ ID NO: 525 - protein, 13 aa, Artificial Sequence
  Description of Artificial Sequence: Synthetic peptide
DIRGAYSSGLFDY

SEQ ID NO: 526 - protein, 11 aa, Artificial Sequence
  Description of Artificial Sequence: Synthetic peptide
WGRGTLVTVSS

SEQ ID NO: 527 - protein, 11 aa, Artificial Sequence
  Description of Artificial Sequence: Synthetic peptide
WGRGTLVTVSS

SEQ ID NO: 528 - protein, 11 aa, Artificial Sequence
  Description of Artificial Sequence: Synthetic peptide
WGRGTLVTVSS

SEQ ID NO: 529 - protein, 11 aa, Artificial Sequence
  Description of Artificial Sequence: Synthetic peptide
WGRGTLVTVSS

SEQ ID NO: 530 - protein, 11 aa, Artificial Sequence
  Description of Artificial Sequence: Synthetic peptide
WGRGTLVTVSS

SEQ ID NO: 531 - protein, 11 aa, Artificial Sequence
  Description of Artificial Sequence: Synthetic peptide
WGRGTLVTVSS

SEQ ID NO: 532 - protein, 11 aa, Artificial Sequence
  Description of Artificial Sequence: Synthetic peptide
WGRGTLVTVSS

SEQ ID NO: 533 - protein, 11 aa, Artificial Sequence
  Description of Artificial Sequence: Synthetic peptide
WGRGTLVTVSS

SEQ ID NO: 534 - protein, 11 aa, Artificial Sequence
  Description of Artificial Sequence: Synthetic peptide
WGRGTLVTVSS

SEQ ID NO: 535 - protein, 11 aa, Artificial Sequence
  Description of Artificial Sequence: Synthetic peptide
WGRGTLVTVSS

SEQ ID NO: 536 - protein, 11 aa, Artificial Sequence
  Description of Artificial Sequence: Synthetic peptide
WGRGTLVTVSS

SEQ ID NO: 537 - protein, 11 aa, Artificial Sequence
  Description of Artificial Sequence: Synthetic peptide
WGRGTLVTVSS

SEQ ID NO: 538 - protein, 11 aa, Artificial Sequence
  Description of Artificial Sequence: Synthetic peptide
WGRGTLVTVSS

SEQ ID NO: 539 - protein, 11 aa, Artificial Sequence
  Description of Artificial Sequence: Synthetic peptide
WGRGTLVTVSS

SEQ ID NO: 540 - protein, 11 aa, Artificial Sequence
  Description of Artificial Sequence: Synthetic peptide
WGRGTLVTVSS

SEQ ID NO: 541 - protein, 11 aa, Artificial Sequence
  Description of Artificial Sequence: Synthetic peptide
WGRGTLVTVSS

SEQ ID NO: 542 - protein, 11 aa, Artificial Sequence
  Description of Artificial Sequence: Synthetic peptide
WGRGTLVTVSS

SEQ ID NO: 543 - protein, 11 aa, Artificial Sequence
  Description of Artificial Sequence: Synthetic peptide
WGRGTLVTVSS

SEQ ID NO: 544 - protein, 11 aa, Artificial Sequence
  Description of Artificial Sequence: Synthetic peptide
WGRGTLVTVSS

SEQ ID NO: 545 - protein, 11 aa, Artificial Sequence
  Description of Artificial Sequence: Synthetic peptide
WGRGTLVTVSS

SEQ ID NO: 546 - protein, 11 aa, Artificial Sequence
  Description of Artificial Sequence: Synthetic peptide
WGRGTLVTVSS

SEQ ID NO: 547 - protein, 11 aa, Artificial Sequence
  Description of Artificial Sequence: Synthetic peptide
WGRGTLVTVSS

SEQ ID NO: 548 - protein, 11 aa, Artificial Sequence
  Description of Artificial Sequence: Synthetic peptide
WGRGTLVTVSS

SEQ ID NO: 549 - protein, 11 aa, Artificial Sequence
  Description of Artificial Sequence: Synthetic peptide
WGRGTLVTVSS

SEQ ID NO: 550 - protein, 11 aa, Artificial Sequence
  Description of Artificial Sequence: Synthetic peptide
WGRGTLVTVSS

SEQ ID NO: 551 - protein, 11 aa, Artificial Sequence
  Description of Artificial Sequence: Synthetic peptide
WGRGTLVTVSS

SEQ ID NO: 552 - protein, 11 aa, Artificial Sequence
  Description of Artificial Sequence: Synthetic peptide
WGRGTLVTVSS

SEQ ID NO: 553 - protein, 11 aa, Artificial Sequence
  Description of Artificial Sequence: Synthetic peptide
WGRGTLVTVSS

SEQ ID NO: 554 - protein, 11 aa, Artificial Sequence
  Description of Artificial Sequence: Synthetic peptide
WGRGTLVTVSS

SEQ ID NO: 555 - protein, 11 aa, Artificial Sequence
  Description of Artificial Sequence: Synthetic peptide
WGRGTLVTVSS

SEQ ID NO: 556 - protein, 11 aa, Artificial Sequence
  Description of Artificial Sequence: Synthetic peptide
WGRGTLVTVSS

SEQ ID NO: 557 - protein, 11 aa, Artificial Sequence
  Description of Artificial Sequence: Synthetic peptide
WGRGTLVTVSS

SEQ ID NO: 558 - protein, 11 aa, Artificial Sequence
  Description of Artificial Sequence: Synthetic peptide
WGRGTLVTVSS

SEQ ID NO: 559 - protein, 11 aa, Artificial Sequence
  Description of Artificial Sequence: Synthetic peptide
WGRGTLVTVSS

SEQ ID NO: 560 - protein, 24 aa, Artificial Sequence
  Description of Artificial Sequence: Synthetic peptide
QDIQMTQSPSSLSASVGDRVTITC

SEQ ID NO: 561 - protein, 24 aa, Artificial Sequence
  Description of Artificial Sequence: Synthetic peptide
QDIQMTQSPSSLSASVGDRVTITC

SEQ ID NO: 562 - protein, 24 aa, Artificial Sequence
  Description of Artificial Sequence: Synthetic peptide
QDIQMTQSPSSLSASVGDRVTITC

SEQ ID NO: 563 - protein, 11 aa, Artificial Sequence
  Description of Artificial Sequence: Synthetic peptide
RANQSIYTYLN

SEQ ID NO: 564 - protein, 11 aa, Artificial Sequence
  Description of Artificial Sequence: Synthetic peptide
RANQSIYTYLN

SEQ ID NO: 565 - protein, 11 aa, Artificial Sequence
  Description of Artificial Sequence: Synthetic peptide
RANQSIYTYLN

SEQ ID NO: 566 - protein, 15 aa, Artificial Sequence
  Description of Artificial Sequence: Synthetic peptide
WYQQKPGKAPELLIY

SEQ ID NO: 567 - protein, 15 aa, Artificial Sequence
  Description of Artificial Sequence: Synthetic peptide
WYQQKPGKAPELLIY

SEQ ID NO: 568 - protein, 15 aa, Artificial Sequence
  Description of Artificial Sequence: Synthetic peptide
WYQQKPGKAPELLIY

SEQ ID NO: 569 - protein, 7 aa, Artificial Sequence
  Description of Artificial Sequence: Synthetic peptide
AASSLQS

SEQ ID NO: 570 - protein, 7 aa, Artificial Sequence
  Description of Artificial Sequence: Synthetic peptide
AASSLQS

SEQ ID NO: 571 - protein, 7 aa, Artificial Sequence
  Description of Artificial Sequence: Synthetic peptide
AASSLQS

SEQ ID NO: 572 - protein, 32 aa, Artificial Sequence; identical to SEQ ID NO: 186
  Description of Artificial Sequence: Synthetic polypeptide

SEQ ID NO: 573 - protein, 32 aa, Artificial Sequence; identical to SEQ ID NO: 186
  Description of Artificial Sequence: Synthetic polypeptide

SEQ ID NO: 574 - protein, 32 aa, Artificial Sequence; identical to SEQ ID NO: 186
  Description of Artificial Sequence: Synthetic polypeptide

SEQ ID NO: 575 - protein, 5 aa, Artificial Sequence
  Description of Artificial Sequence: Synthetic peptide
QQAGI

SEQ ID NO: 576 - protein, 5 aa, Artificial Sequence
  Description of Artificial Sequence: Synthetic peptide
QQAGI

SEQ ID NO: 577 - protein, 5 aa, Artificial Sequence
  Description of Artificial Sequence: Synthetic peptide
QQAGI

SEQ ID NO: 578 - protein, 10 aa, Artificial Sequence
  Description of Artificial Sequence: Synthetic peptide
FGQGTKLEIK

SEQ ID NO: 579 - protein, 10 aa, Artificial Sequence
  Description of Artificial Sequence: Synthetic peptide
FGQGTKLEIK

SEQ ID NO: 580 - protein, 10 aa, Artificial Sequence
  Description of Artificial Sequence: Synthetic peptide
FGQGTKLEIK

SEQ ID NO: 581 - protein, 7 aa, Artificial Sequence
  Description of Artificial Sequence: Synthetic peptide
RTVAAPS

SEQ ID NO: 582 - protein, 7 aa, Artificial Sequence
  Description of Artificial Sequence: Synthetic peptide
RTVAAPS

SEQ ID NO: 583 - protein, 7 aa, Artificial Sequence
  Description of Artificial Sequence: Synthetic peptide
RTVAAPS

SEQ ID NO: 584 - protein, 21 aa, Artificial Sequence
  Description of Artificial Sequence: Synthetic peptide
MKKLLFAIPLVVPFVAQPAMA

SEQ ID NO: 585 - protein, 21 aa, Artificial Sequence
  Description of Artificial Sequence: Synthetic peptide
MKKLLFAIPLVVPFVAQPAMA

SEQ ID NO: 586 - protein, 21 aa, Artificial Sequence
  Description of Artificial Sequence: Synthetic peptide
MKKLLFAIPLVVPFVAQPAMA

SEQ ID NO: 587 - protein, 30 aa, Artificial Sequence; identical to SEQ ID NO: 322
  Description of Artificial Sequence: Synthetic polypeptide

SEQ ID NO: 588 - protein, 30 aa, Artificial Sequence; identical to SEQ ID NO: 322
  Description of Artificial Sequence: Synthetic polypeptide

SEQ ID NO: 589 - protein, 30 aa, Artificial Sequence; identical to SEQ ID NO: 322
  Description of Artificial Sequence: Synthetic polypeptide

SEQ ID NO: 590 - protein, 5 aa, Artificial Sequence
  Description of Artificial Sequence: Synthetic peptide
WYNMA

SEQ ID NO: 591 - protein, 5 aa, Artificial Sequence
  Description of Artificial Sequence: Synthetic peptide
WYNMG

SEQ ID NO: 592 - protein, 5 aa, Artificial Sequence
  Description of Artificial Sequence: Synthetic peptide
WYNMV

SEQ ID NO: 593 - protein, 14 aa, Artificial Sequence
  Description of Artificial Sequence: Synthetic peptide
WVRQAPGKGLEWVS

SEQ ID NO: 594 - protein, 14 aa, Artificial Sequence
  Description of Artificial Sequence: Synthetic peptide
WVRQAPGKGLEWVS

SEQ ID NO: 595 - protein, 14 aa, Artificial Sequence
  Description of Artificial Sequence: Synthetic peptide
WVRQAPGKGLEWVS

SEQ ID NO: 596 - protein, 17 aa, Artificial Sequence
  Description of Artificial Sequence: Synthetic peptide
RISPSGGDTGYADSVKG

SEQ ID NO: 597 - protein, 17 aa, Artificial Sequence
  Description of Artificial Sequence: Synthetic peptide
RISPSGGDTGYADSVKG

SEQ ID NO: 598 - protein, 17 aa, Artificial Sequence
  Description of Artificial Sequence: Synthetic peptide
RISPSGGDTGYADSVKG

SEQ ID NO: 599 - protein, 32 aa, Artificial Sequence; identical to SEQ ID NO: 458
  Description of Artificial Sequence: Synthetic polypeptide

SEQ ID NO: 600 - protein, 32 aa, Artificial Sequence; identical to SEQ ID NO: 458
  Description of Artificial Sequence: Synthetic polypeptide

SEQ ID NO: 601 - protein, 32 aa, Artificial Sequence; identical to SEQ ID NO: 458
  Description of Artificial Sequence: Synthetic polypeptide

SEQ ID NO: 602 - protein, 13 aa, Artificial Sequence
  Description of Artificial Sequence: Synthetic peptide
DIRGAYSSGLFDY

SEQ ID NO: 603 - protein, 13 aa, Artificial Sequence
  Description of Artificial Sequence: Synthetic peptide
DIRGAYSSGLFDY

SEQ ID NO: 604 - protein, 13 aa, Artificial Sequence
  Description of Artificial Sequence: Synthetic peptide
DIRGAYSSGLFDY

SEQ ID NO: 605 - protein, 11 aa, Artificial Sequence
  Description of Artificial Sequence: Synthetic peptide
WGRGTLVTVSS

SEQ ID NO: 606 - protein, 11 aa, Artificial Sequence
  Description of Artificial Sequence: Synthetic peptide
WGRGTLVTVSS

SEQ ID NO: 607 - protein, 11 aa, Artificial Sequence
  Description of Artificial Sequence: Synthetic peptide
WGRGTLVTVSS

SEQ ID NO: 608 - protein, 104 aa, Artificial Sequence
  Description of Artificial Sequence: Synthetic polypeptide
QDIQMTQSPSSLSASVGDRVTITCRANQSIYTYLNWYQQKPGKAPELLIYAASSLQSGVPSRFSGSGSGTDFTLTISSLQPEDFATYYCQQAGIFGQGTKLEIK

SEQ ID NO: 609 - protein, 104 aa, Artificial Sequence; identical to SEQ ID NO: 608
  Description of Artificial Sequence: Synthetic polypeptide

SEQ ID NO: 610 - protein, 104 aa, Artificial Sequence; identical to SEQ ID NO: 608
  Description of Artificial Sequence: Synthetic polypeptide

SEQ ID NO: 611 - protein, 104 aa, Artificial Sequence; identical to SEQ ID NO: 608
  Description of Artificial Sequence: Synthetic polypeptide

SEQ ID NO: 612 - protein, 104 aa, Artificial Sequence; identical to SEQ ID NO: 608
  Description of Artificial Sequence: Synthetic polypeptide

SEQ ID NO: 613 - protein, 104 aa, Artificial Sequence; identical to SEQ ID NO: 608
  Description of Artificial Sequence: Synthetic polypeptide

SEQ ID NO: 614 - protein, 104 aa, Artificial Sequence; identical to SEQ ID NO: 608
  Description of Artificial Sequence: Synthetic polypeptide

SEQ ID NO: 615 - protein, 104 aa, Artificial Sequence; identical to SEQ ID NO: 608
  Description of Artificial Sequence: Synthetic polypeptide

SEQ ID NO: 616 - protein, 104 aa, Artificial Sequence; identical to SEQ ID NO: 608
  Description of Artificial Sequence: Synthetic polypeptide

SEQ ID NO: 617 - protein, 104 aa, Artificial Sequence; identical to SEQ ID NO: 608
  Description of Artificial Sequence: Synthetic polypeptide

SEQ ID NO: 618 - protein, 104 aa, Artificial Sequence; identical to SEQ ID NO: 608
  Description of Artificial Sequence: Synthetic polypeptide

SEQ ID NO: 619 - protein, 104 aa, Artificial Sequence; identical to SEQ ID NO: 608
  Description of Artificial Sequence: Synthetic polypeptide

SEQ ID NO: 620 - protein, 104 aa, Artificial Sequence; identical to SEQ ID NO: 608
  Description of Artificial Sequence: Synthetic polypeptide

SEQ ID NO: 621 - protein, 104 aa, Artificial Sequence; identical to SEQ ID NO: 608
  Description of Artificial Sequence: Synthetic polypeptide

SEQ ID NO: 622 - protein, 104 aa, Artificial Sequence; identical to SEQ ID NO: 608
  Description of Artificial Sequence: Synthetic polypeptide

SEQ ID NO: 623 - protein, 104 aa, Artificial Sequence; identical to SEQ ID NO: 608
  Description of Artificial Sequence: Synthetic polypeptide

SEQ ID NO: 624 - protein, 104 aa, Artificial Sequence; identical to SEQ ID NO: 608
  Description of Artificial Sequence: Synthetic polypeptide

SEQ ID NO: 625 - protein, 104 aa, Artificial Sequence; identical to SEQ ID NO: 608
  Description of Artificial Sequence: Synthetic polypeptide

SEQ ID NO: 626 - protein, 104 aa, Artificial Sequence; identical to SEQ ID NO: 608
  Description of Artificial Sequence: Synthetic polypeptide

SEQ ID NO: 627 - protein, 104 aa, Artificial Sequence; identical to SEQ ID NO: 608
  Description of Artificial Sequence: Synthetic polypeptide

SEQ ID NO: 628 - protein, 104 aa, Artificial Sequence; identical to SEQ ID NO: 608
  Description of Artificial Sequence: Synthetic polypeptide

SEQ ID NO: 629 - protein, 104 aa, Artificial Sequence; identical to SEQ ID NO: 608
  Description of Artificial Sequence: Synthetic polypeptide

SEQ ID NO: 630 - protein, 104 aa, Artificial Sequence; identical to SEQ ID NO: 608
  Description of Artificial Sequence: Synthetic polypeptide

SEQ ID NO: 631 - protein, 104 aa, Artificial Sequence; identical to SEQ ID NO: 608
  Description of Artificial Sequence: Synthetic polypeptide

SEQ ID NO: 632 - protein, 104 aa, Artificial Sequence; identical to SEQ ID NO: 608
  Description of Artificial Sequence: Synthetic polypeptide

SEQ ID NO: 633 - protein, 104 aa, Artificial Sequence; identical to SEQ ID NO: 608
  Description of Artificial Sequence: Synthetic polypeptide

SEQ ID NO: 634 - protein, 104 aa, Artificial Sequence; identical to SEQ ID NO: 608
  Description of Artificial Sequence: Synthetic polypeptide

SEQ ID NO: 635 - protein, 104 aa, Artificial Sequence; identical to SEQ ID NO: 608
  Description of Artificial Sequence: Synthetic polypeptide

SEQ ID NO: 636 - protein, 108 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 637 - protein, 104 aa, Artificial Sequence; identical to SEQ ID NO: 608
  Description of Artificial Sequence: Synthetic polypeptide

SEQ ID NO: 638 - protein, 104 aa, Artificial Sequence; identical to SEQ ID NO: 608
  Description of Artificial Sequence: Synthetic polypeptide

SEQ ID NO: 639 - protein, 104 aa, Artificial Sequence; identical to SEQ ID NO: 608
  Description of Artificial Sequence: Synthetic polypeptide

SEQ ID NO: 640 - protein, 110 aa, Artificial Sequence
  Description of Artificial Sequence: Synthetic polypeptide
QDIQMTQSPGTLSLSPGERATMSCRASQSFTGSYLAWYQQKPGLAPRLLIYDASSRAAGIPDRFSGSGSGTDFTLTISRLEPEDFAVYYCQQYGTSPPWAFGQGTKVEIK

SEQ ID NO: 641 - protein, 104 aa, Artificial Sequence; identical to SEQ ID NO: 608
  Description of Artificial Sequence: Synthetic polypeptide

SEQ ID NO: 642 - protein, 122 aa, Artificial Sequence
  Description of Artificial Sequence: Synthetic polypeptide
EVQLLESGGGLVQPGGSLRLSCAASGFTFSQYWMGWVRQAPGKGLEWVSSISPSGGMTMYADSVKGRFTISRDNSKNTLYLQMNSLRAEDTAVYYCAKDIRGAYSSGLFDYWGRGTLVTVSS

SEQ ID NO: 643 - protein, 122 aa, Artificial Sequence
  Description of Artificial Sequence: Synthetic polypeptide
EVQLLESGGGLVQPGGSLRLSCAASGFTFSDYGMAWVRQAPGKGLEWVSSISPSGGWTLYADSVKGRFTISRDNSKNTLYLQMNSLRAEDTAVYYCAKDIRGAYSSGLFDYWGRGTLVTVSS

SEQ ID NO: 644 - protein, 122 aa, Artificial Sequence
  Description of Artificial Sequence: Synthetic polypeptide
EVQLLESGGGLVQPGGSLRLSCAASGFTFSWYWMGWVRQAPGKGLEWVSSISPSGGYTFYADSVKGRFTISRDNSKNTLYLQMNSLRAEDTAVYYCAKDIRGAYSSGLFDYWGRGTLVTVSS

SEQ ID NO: 645 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGIGPSGGLTFYADSVKGRFTISRDNSKNTLYLQMNSLRAEDTAVYYCAKDIRGAYSSGLFDYWGRGTLVTVSS

SEQ ID NO: 646 - protein, 122 aa, Artificial Sequence
  Description of Artificial Sequence: Synthetic polypeptide
EVQLLESGGGLVQPGGSLRLSCAASGFTFSPYWMSWVRQAPGKGLEWVSGISPSGGITFYADSVKGRFTISRDNSKNTLYLQMNSLRAEDTAVYYCAKDIRGAYSSGLFDYWGRGTLVTVSS

SEQ ID NO: 647 - protein, 122 aa, Artificial Sequence
  Description of Artificial Sequence: Synthetic polypeptide
EVQLLESGGGLVQPGGSLRLSCAASGFTFSWYWMVWVRQAPGKGLEWVSSIGPSGGDTYYADSVKGRFTISRDNSKNTLYLQMNSLRAEDTAVYYCAKDIRGAYSSGLFDYWGRGTLVTVSS

SEQ ID NO: 648 - protein, 122 aa, Artificial Sequence
  Description of Artificial Sequence: Synthetic polypeptide
EVQLLESGGGLVQPGGSLRLSCAASGFTFSWYNMHWVRQAPGKGLEWVSGISPSGGNTMYADSVKGRFTISRDNSKNTLYLQMNSLRAEDTAVYYCAKDIRGAYSSGLFDYWGRGTLVTVSS

SEQ ID NO: 649 - protein, 122 aa, Artificial Sequence
  Description of Artificial Sequence: Synthetic polypeptide
EVQLLESGGGLVQPGGSLRLSCAASGFTFSWYGMGWVRQAPGKGLEWVSVIVSSGGFTQYADSVKGRFTISRDNSKNTLYLQMNSLRAEDTAVYYCAKDIRGAYSSGLFDYWGRGTLVTVSS

SEQ ID NO: 650 - protein, 122 aa, Artificial Sequence
  Description of Artificial Sequence: Synthetic polypeptide
EVQLLESGGGLVQPGGSLRLSCAASGFTFSYYGMGWVRQAPGKGLEWVSVISSSGGFTFYADSVKGRFTISRDNSKNTLYLQMNSLRAEDTAVYYCAKDIRGAYSSGLFDYWGRGTLVTVSS

SEQ ID NO: 651 - protein, 122 aa, Artificial Sequence
  Description of Artificial Sequence: Synthetic polypeptide
EVQLLESGGGLVQPGGSLRLSCAASGFTFSQYWMSWVRQAPGKGLEWVSSISPSGGETFYADSVKGRFTISRDNSKNTLYLQMNSLRAEDTAVYYCAKDIRGAYSSGLFDYWGRGTLVTVSS

SEQ ID NO: 652 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGIVSSGGTTIYADSVKGRFTISRDNSKNTLYLQMNSLRAEDTAVYYCAKDIRGAYSSGLFDYWGRGTLVTVSS

SEQ ID NO: 653 - protein, 122 aa, Artificial Sequence
  Description of Artificial Sequence: Synthetic polypeptide
EVQLLESGGGLVQPGGSLRLSCAASGFTFSRYNMHWVRQAPGKGLEWVSGIVPSGGTTHYADSVKGRFTISRDNSKNTLYLQMNSLRAEDTAVYYCAKDIRGAYSSGLFDYWGRGTLVTVSS

SEQ ID NO: 654 - protein, 122 aa, Artificial Sequence
  Description of Artificial Sequence: Synthetic polypeptide
EVQLLESGGGLVQPGGSLRLSCAASGFTFSVYGMSWVRQAPGKGLEWVSRIVPSGGRTGYADSVKGRFTISRDNSKNTLYLQMNSLRAEDTAVYYCAKDIRGAYSSGLFDYWGRGTLVTVSS

SEQ ID NO: 655 - protein, 122 aa, Artificial Sequence
  Description of Artificial Sequence: Synthetic polypeptide
EVQLLESGGGLVQPGGSLRLSCAASGFTFSEYWMAWVRQAPGKGLEWVSSISPSGGHTFYADSVKGRFTISRDNSKNTLYLQMNSLRAEDTAVYYCAKDIRGAYSSGLFDYWGRGTLVTVSS

SEQ ID NO: 656 - protein, 122 aa, Artificial Sequence
  Description of Artificial Sequence: Synthetic polypeptide
EVQLLESGGGLVQPGGSLRLSCAASGFTFSWYNMSWVRQAPGKGLEWVSRISPSGGDTGYADSVKGRFTISRDNSKNTLYLQMNSLRAEDTAVYYCAKDIRGAYSSGLFDYWGRGTLVTVSS

SEQ ID NO: 657 - protein, 122 aa, Artificial Sequence
  Description of Artificial Sequence: Synthetic polypeptide
EVQLLESGGGLVQPGGSLRLSCAASGFTFSEYWMGWVRQAPGKGLEWVSSIYPSGGNTIYADSVKGRFTISRDNSKNTLYLQMNSLRAEDTAVYYCAKDIRGAYSSGLFDYWGRGTLVTVSS

SEQ ID NO: 658 - protein, 122 aa, Artificial Sequence
  Description of Artificial Sequence: Synthetic polypeptide
EVQLLESGGGLVQPGGSLRLSCAASGFTFSYYNMSWVRQAPGKGLEWVSGISPSGGPTGYADSVKGRFTISRDNSKNTLYLQMNSLRAEDTAVYYCAKDIRGAYSSGLFDYWGRGTLVTVSS

SEQ ID NO: 659 - protein, 122 aa, Artificial Sequence
  Description of Artificial Sequence: Synthetic polypeptide
EVQLLESGGGLVQPGGSLRLSCAASGFTFSYYNMHWVRQAPGKGLEWVSGIGPSGGGTLYADSVKGRFTISRDNSKNTLYLQMNSLRAEDTAVYYCAKDIRGAYSSGLFDYWGRGTLVTVSS

SEQ ID NO: 660 - protein, 122 aa, Artificial Sequence
  Description of Artificial Sequence: Synthetic polypeptide
EVQLLESGGGLVQPGGSLRLSCAASGFTFSLYHMHWVRQAPGKGLEWVSGIGPSGGWTIYADSVKGRFTISRDNSKNTLYLQMNSLRAEDTAVYYCAKDIRGAYSSGLFDYWGRGTLVTVSS

SEQ ID NO: 661 - protein, 122 aa, Artificial Sequence
  Description of Artificial Sequence: Synthetic polypeptide
EVQLLESGGGLVQPGGSLRLSCAASGFTFSEYNMHWVRQAPGKGLEWVSGISPSGGMTHYADSVKGRFTISRDNSKNTLYLQMNSLRAEDTAVYYCAKDIRGAYSSGLFDYWGRGTLVTVSS

SEQ ID NO: 662 - protein, 122 aa, Artificial Sequence
  Description of Artificial Sequence: Synthetic polypeptide
EVQLLESGGGLVQPGGSLRLSCAASGFTFSEYWMTWVRQAPGKGLEWVSGISPSGGMTFYADSVKGRFTISRDNSKNTLYLQMNSLRAEDTAVYYCAKDIRGAYSSGLFDYWGRGTLVTVSS

SEQ ID NO: 663 - protein, 122 aa, Artificial Sequence
  Description of Artificial Sequence: Synthetic polypeptide
EVQLLESGGGLVQPGGSLRLSCAASGFTFSHYWMHWVRQAPGKGLEWVSGISPSGGMTMYADSVKGRFTISRDNSKNTLYLQMNSLRAEDTAVYYCAKDIRGAYSSGLFDYWGRGTLVTVSS

SEQ ID NO: 664 - protein, 122 aa, Artificial Sequence
  Description of Artificial Sequence: Synthetic polypeptide
EVQLLESGGGLVQPGGSLRLSCAASGFTFSQYNMHWVRQAPGKGLEWVSGIGPSGGITIYADSVKGRFTISRDNSKNTLYLQMNSLRAEDTAVYYCAKDIRGAYSSGLFDYWGRGTLVTVSS

SEQ ID NO: 665 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGISSSGGDTLYADSVKGRFTISRDNSKNTLYLQMNSLRAEDTAVYYCAKDIRGAYSSGLFDYWGRGTLVTVSS

SEQ ID NO: 666 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGIGPSGGPTFYADSIKGRFTISRDNSKNTLYLQMNSLRAEDTAVYYCAKDIRGAYSSGLFDYWGRGTLVTVSS

SEQ ID NO: 667 - protein, 122 aa, Artificial Sequence
  Description of Artificial Sequence: Synthetic polypeptide
EVQLLESGGGLVQPGGSLRLSCAASGFTFSAYGMSWVRQAPGKGLEWVSRISPSGGITGYADSVKGRFTISRDNSKNTLYLQMNSLRAEDTAVYYCAKDIRGAYSSGLFDYWGRGTLVTVSS

SEQ ID NO: 668 - protein, 122 aa, Artificial Sequence
  Description of Artificial Sequence: Synthetic polypeptide
EVQLLESGGGLVQPGGSLRLSCAASGFTFSWYYMGWVRQAPGKGLEWVSSISPSGGWTRYADSVKGRFTISRDNSKNTLYLQMNSLRAEDTAVYYCAKDIRGAYSSGLFDYWGRGTLVTVSS

SEQ ID NO: 669 - protein, 122 aa, Artificial Sequence
  Description of Artificial Sequence: Synthetic polypeptide
EVQLLESGGGLVQPGGSLRLSCAASGFTFSFYWMDWVRQAPGKGLEWVSSISPSGGTTIYADSVKGRFTISRDNSKNTLYLQMNSLRAEDTAVYYCAKDIRGAYSSGLFDYWGRGTLVTVSS

SEQ ID NO: 670 - protein, 122 aa, Artificial Sequence
  Description of Artificial Sequence: Synthetic polypeptide
EVQLLESGGGLVQPGGSLRLSCAASGFTFSDYNMHWVRQAPGKGLEWVSYIGPSGGYTHYADSVKGRFTISRDNSKNTLYLQMNSLRAEDTAVYYCAKDIRGAYSSGLFDYWGRGTLVTVSS

SEQ ID NO: 671 - protein, 122 aa, Artificial Sequence
  Description of Artificial Sequence: Synthetic polypeptide
EVQLLESGGGLVQPGGSLRLSCAASGFTFSWYWMVWVRQAPGKGLEWVSSIVPSGGFTIYADSVKGRFTISRDNSKNTLYLQMNSLRAEDTAVYYCAKDIRGAYSSGLFDYWGRGTLVTVSS

SEQ ID NO: 672 - protein, 122 aa, Artificial Sequence
  Description of Artificial Sequence: Synthetic polypeptide
EVQLLESGGGLVQPGGSLRLSCAASGFTFSRYMMHWVRQAPGKGLEWVSYISSSGGTTIYADSVKGRFTISRDNSKNTLYLQMNSLRAEDTAVYYCAKDIRGAYSSGLFDYWGRGTLVTVSS

SEQ ID NO: 673 - protein, 122 aa, Artificial Sequence
  Description of Artificial Sequence: Synthetic polypeptide
EVQLLESGGGLVQPGGSLRLSCAASGFTFSHYWMQWVRQAPGKGLEWVSGIVPSGGLTMYADSVKGRFTISRDNSKNTLYLQMNSLRAEDTAVYYCAKDIRGAYSSGLFDYWGRGTLVTVSS

SEQ ID NO: 674 - protein, 122 aa, Artificial Sequence; identical to SEQ ID NO: 670
  Description of Artificial Sequence: Synthetic polypeptide

SEQ ID NO: 675 - protein, 122 aa, Artificial Sequence
  Description of Artificial Sequence: Synthetic polypeptide
EVQLLESGGGLVQPGGSLRLSCAASGFTFSDYWMAWVRQAPGKGLEWVSSIGPSGGFTVYADSVKGRFTISRDNSKNTLYLQMNSLRAEDTAVYYCAKDIRGAYSSGLFDYWGRGTLVTVSS

SEQ ID NO: 676 - protein, 24 aa, Artificial Sequence
  Description of Artificial Sequence: Synthetic peptide
QDIQMTQSPSSLSASVGDRVTITC

SEQ ID NO: 677 - protein, 24 aa, Artificial Sequence
  Description of Artificial Sequence: Synthetic peptide
QDIQMTQSPSSLSASVGDRVTITC

SEQ ID NO: 678 - protein, 24 aa, Artificial Sequence
  Description of Artificial Sequence: Synthetic peptide
QDIQMTQSPSSLSASVGDRVTITC

SEQ ID NO: 679 - protein, 24 aa, Artificial Sequence
  Description of Artificial Sequence: Synthetic peptide
QDIQMTQSPSSLSASVGDRVTITC

SEQ ID NO: 680 - protein, 24 aa, Artificial Sequence
  Description of Artificial Sequence: Synthetic peptide
QDIQMTQSPSSLSASVGDRVTITC

SEQ ID NO: 681 - protein, 24 aa, Artificial Sequence
  Description of Artificial Sequence: Synthetic peptide
QDIQMTQSPSSLSASVGDRVTITC

SEQ ID NO: 682 - protein, 24 aa, Artificial Sequence
  Description of Artificial Sequence: Synthetic peptide
QDIQMTQSPSSLSASVGDRVTITC

SEQ ID NO: 683 - protein, 24 aa, Artificial Sequence
  Description of Artificial Sequence: Synthetic peptide
QDIQMTQSPSSLSASVGDRVTITC

SEQ ID NO: 684 - protein, 24 aa, Artificial Sequence
  Description of Artificial Sequence: Synthetic peptide
QDIQMTQSPSSLSASVGDRVTITC

SEQ ID NO: 685 - protein, 24 aa, Artificial Sequence
  Description of Artificial Sequence: Synthetic peptide
QDIQMTQSPSSLSASVGDRVTITC

SEQ ID NO: 686 - protein, 24 aa, Artificial Sequence
  Description of Artificial Sequence: Synthetic peptide
QDIQMTQSPSSLSASVGDRVTITC

SEQ ID NO: 687 - protein, 24 aa, Artificial Sequence
  Description of Artificial Sequence: Synthetic peptide
QDIQMTQSPSSLSASVGDRVTITC

SEQ ID NO: 688 - protein, 24 aa, Artificial Sequence
  Description of Artificial Sequence: Synthetic peptide
QDIQMTQSPSSLSASVGDRVTITC

SEQ ID NO: 689 - protein, 24 aa, Artificial Sequence
  Description of Artificial Sequence: Synthetic peptide
QDIQMTQSPSSLSASVGDRVTITC

SEQ ID NO: 690 - protein, 24 aa, Artificial Sequence
  Description of Artificial Sequence: Synthetic peptide
QDIQMTQSPSSLSASVGDRVTITC

SEQ ID NO: 691 - protein, 24 aa, Artificial Sequence
  Description of Artificial Sequence: Synthetic peptide
QDIQMTQSPSSLSASVGDRVTITC

SEQ ID NO: 692 - protein, 24 aa, Artificial Sequence
  Description of Artificial Sequence: Synthetic peptide
QDIQMTQSPSSLSASVGDRVTITC

SEQ ID NO: 693 - protein, 24 aa, Artificial Sequence
  Description of Artificial Sequence: Synthetic peptide
QDIQMTQSPSSLSASVGDRVTITC

SEQ ID NO: 694 - protein, 24 aa, Artificial Sequence
  Description of Artificial Sequence: Synthetic peptide
QDIQMTQSPSSLSASVGDRVTITC

SEQ ID NO: 695 - protein, 24 aa, Artificial Sequence
  Description of Artificial Sequence: Synthetic peptide
QDIQMTQSPSSLSASVGDRVTITC

SEQ ID NO: 696 - protein, 24 aa, Artificial Sequence
  Description of Artificial Sequence: Synthetic peptide
QDIQMTQSPSSLSASVGDRVTITC

SEQ ID NO: 697 - protein, 24 aa, Artificial Sequence
  Description of Artificial Sequence: Synthetic peptide
QDIQMTQSPSSLSASVGDRVTITC

SEQ ID NO: 698 - protein, 24 aa, Artificial Sequence
  Description of Artificial Sequence: Synthetic peptide
QDIQMTQSPSSLSASVGDRVTITC

SEQ ID NO: 699 - protein, 24 aa, Artificial Sequence
  Description of Artificial Sequence: Synthetic peptide
QDIQMTQSPSSLSASVGDRVTITC

SEQ ID NO: 700 - protein, 24 aa, Artificial Sequence
  Description of Artificial Sequence: Synthetic peptide
QDIQMTQSPSSLSASVGDRVTITC

SEQ ID NO: 701 - protein, 11 aa, Artificial Sequence
  Description of Artificial Sequence: Synthetic peptide
RANQSIYTYLN

SEQ ID NO: 702 - protein, 11 aa, Artificial Sequence
  Description of Artificial Sequence: Synthetic peptide
RANQSIYTYLN

SEQ ID NO: 703 - protein, 11 aa, Artificial Sequence
  Description of Artificial Sequence: Synthetic peptide
RANQSIYTYLN

SEQ ID NO: 704 - protein, 11 aa, Artificial Sequence
  Description of Artificial Sequence: Synthetic peptide
RANQSIYTYLN

SEQ ID NO: 705 - protein, 11 aa, Artificial Sequence
  Description of Artificial Sequence: Synthetic peptide
RANQSIYTYLN

SEQ ID NO: 706 - protein, 11 aa, Artificial Sequence
  Description of Artificial Sequence: Synthetic peptide
RANQSIYTYLN

SEQ ID NO: 707 - protein, 11 aa, Artificial Sequence
  Description of Artificial Sequence: Synthetic peptide
RANQSIYTYLN

SEQ ID NO: 708 - protein, 11 aa, Artificial Sequence
  Description of Artificial Sequence: Synthetic peptide
RANQSIYTYLN

SEQ ID NO: 709 - protein, 11 aa, Artificial Sequence
  Description of Artificial Sequence: Synthetic peptide
RANQSIYTYLN

SEQ ID NO: 710 - protein, 11 aa, Artificial Sequence
  Description of Artificial Sequence: Synthetic peptide
RANQSIYTYLN

SEQ ID NO: 711 - protein, 11 aa, Artificial Sequence
  Description of Artificial Sequence: Synthetic peptide
RANQSIYTYLN

SEQ ID NO: 712 - protein, 11 aa, Artificial Sequence
  Description of Artificial Sequence: Synthetic peptide
RANQSIYTYLN

SEQ ID NO: 713 - protein, 11 aa, Artificial Sequence
  Description of Artificial Sequence: Synthetic peptide
RANQSIYTYLN

SEQ ID NO: 714 - protein, 11 aa, Artificial Sequence
  Description of Artificial Sequence: Synthetic peptide
RANQSIYTYLN

SEQ ID NO: 715 - protein, 11 aa, Artificial Sequence
  Description of Artificial Sequence: Synthetic peptide
RANQSIYTYLN

SEQ ID NO: 716 - protein, 11 aa, Artificial Sequence
  Description of Artificial Sequence: Synthetic peptide
RANQSIYTYLN

SEQ ID NO: 717 - protein, 11 aa, Artificial Sequence
  Description of Artificial Sequence: Synthetic peptide
RANQSIYTYLN

SEQ ID NO: 718 - protein, 11 aa, Artificial Sequence
  Description of Artificial Sequence: Synthetic peptide
RANQSIYTYLN

SEQ ID NO: 719 - protein, 11 aa, Artificial Sequence
  Description of Artificial Sequence: Synthetic peptide
RANQSIYTYLN

SEQ ID NO: 720 - protein, 11 aa, Artificial Sequence
  Description of Artificial Sequence: Synthetic peptide
RANQSIYTYLN

SEQ ID NO: 721 - protein, 11 aa, Artificial Sequence
  Description of Artificial Sequence: Synthetic peptide
RANQSIYTYLN

SEQ ID NO: 722 - protein, 11 aa, Artificial Sequence
  Description of Artificial Sequence: Synthetic peptide
RANQSIYTYLN

SEQ ID NO: 723 - protein, 11 aa, Artificial Sequence
  Description of Artificial Sequence: Synthetic peptide
RANQSIYTYLN

SEQ ID NO: 724 - protein, 11 aa, Artificial Sequence
  Description of Artificial Sequence: Synthetic peptide
RANQSIYTYLN

SEQ ID NO: 725 - protein, 11 aa, Artificial Sequence
  Description of Artificial Sequence: Synthetic peptide
RANQSIYTYLN

SEQ ID NO: 726 - protein, 15 aa, Artificial Sequence
  Description of Artificial Sequence: Synthetic peptide
WYQQKPGKAPELLIY

SEQ ID NO: 727 - protein, 15 aa, Artificial Sequence
  Description of Artificial Sequence: Synthetic peptide
WYQQKPGKAPELLIY

SEQ ID NO: 728 - protein, 15 aa, Artificial Sequence
  Description of Artificial Sequence: Synthetic peptide
WYQQKPGKAPELLIY

SEQ ID NO: 729 - protein, 15 aa, Artificial Sequence
  Description of Artificial Sequence: Synthetic peptide
WYQQKPGKAPELLIY

SEQ ID NO: 730 - protein, 15 aa, Artificial Sequence
  Description of Artificial Sequence: Synthetic peptide
WYQQKPGKAPELLIY

SEQ ID NO: 731 - protein, 15 aa, Artificial Sequence
  Description of Artificial Sequence: Synthetic peptide
WYQQKPGKAPELLIY

SEQ ID NO: 732 - protein, 15 aa, Artificial Sequence
  Description of Artificial Sequence: Synthetic peptide
WYQQKPGKAPELLIY

SEQ ID NO: 733 - protein, 15 aa, Artificial Sequence
  Description of Artificial Sequence: Synthetic peptide
WYQQKPGKAPELLIY

SEQ ID NO: 734 - protein, 15 aa, Artificial Sequence
  Description of Artificial Sequence: Synthetic peptide
WYQQKPGKAPELLIY

SEQ ID NO: 735 - protein, 15 aa, Artificial Sequence
  Description of Artificial Sequence: Synthetic peptide
WYQQKPGKAPELLIY

SEQ ID NO: 736 - protein, 15 aa, Artificial Sequence
  Description of Artificial Sequence: Synthetic peptide
WYQQKPGKAPELLIY

SEQ ID NO: 737 - protein, 15 aa, Artificial Sequence
  Description of Artificial Sequence: Synthetic peptide
WYQQKPGKAPELLIY

SEQ ID NO: 738 - protein, 15 aa, Artificial Sequence
  Description of Artificial Sequence: Synthetic peptide
WYQQKPGKAPELLIY

SEQ ID NO: 739 - protein, 15 aa, Artificial Sequence
  Description of Artificial Sequence: Synthetic peptide
WYQQKPGKAPELLIY

SEQ ID NO: 740 - protein, 15 aa, Artificial Sequence
  Description of Artificial Sequence: Synthetic peptide
WYQQKPGKAPELLIY

SEQ ID NO: 741 - protein, 15 aa, Artificial Sequence
  Description of Artificial Sequence: Synthetic peptide
WYQQKPGKAPELLIY

SEQ ID NO: 742 - protein, 15 aa, Artificial Sequence
  Description of Artificial Sequence: Synthetic peptide
WYQQKPGKAPELLIY

SEQ ID NO: 743 - protein, 15 aa, Artificial Sequence
  Description of Artificial Sequence: Synthetic peptide
WYQQKPGKAPELLIY

SEQ ID NO: 744 - protein, 15 aa, Artificial Sequence
  Description of Artificial Sequence: Synthetic peptide
WYQQKPGKAPELLIY

SEQ ID NO: 745 - protein, 15 aa, Artificial Sequence
  Description of Artificial Sequence: Synthetic peptide
WYQQKPGKAPELLIY

SEQ ID NO: 746 - protein, 15 aa, Artificial Sequence
  Description of Artificial Sequence: Synthetic peptide
WYQQKPGKAPELLIY

SEQ ID NO: 747 - protein, 15 aa, Artificial Sequence
  Description of Artificial Sequence: Synthetic peptide
WYQQKPGKAPELLIY

SEQ ID NO: 748 - protein, 15 aa, Artificial Sequence
  Description of Artificial Sequence: Synthetic peptide
WYQQKPGKAPELLIY

SEQ ID NO: 749 - protein, 15 aa, Artificial Sequence
  Description of Artificial Sequence: Synthetic peptide
WYQQKPGKAPELLIY

SEQ ID NO: 750 - protein, 15 aa, Artificial Sequence
  Description of Artificial Sequence: Synthetic peptide
WYQQKPGKAPELLIY

SEQ ID NO: 751 - protein, 7 aa, Artificial Sequence
  Description of Artificial Sequence: Synthetic peptide
AASSLQS

SEQ ID NO: 752 - protein, 7 aa, Artificial Sequence
  Description of Artificial Sequence: Synthetic peptide
AASSLQS

SEQ ID NO: 753 - protein, 7 aa, Artificial Sequence
  Description of Artificial Sequence: Synthetic peptide
AASSLQS

SEQ ID NO: 754 - protein, 7 aa, Artificial Sequence
  Description of Artificial Sequence: Synthetic peptide
AASSLQS

SEQ ID NO: 755 - protein, 7 aa, Artificial Sequence
  Description of Artificial Sequence: Synthetic peptide
AASSLQS

SEQ ID NO: 756 - protein, 7 aa, Artificial Sequence
  Description of Artificial Sequence: Synthetic peptide
AASSLQS

SEQ ID NO: 757 - protein, 7 aa, Artificial Sequence
  Description of Artificial Sequence: Synthetic peptide
AASSLQS

SEQ ID NO: 758 - protein, 7 aa, Artificial Sequence
  Description of Artificial Sequence: Synthetic peptide
AASSLQS

SEQ ID NO: 759 - protein, 7 aa, Artificial Sequence
  Description of Artificial Sequence: Synthetic peptide
AASSLQS

SEQ ID NO: 760 - protein, 7 aa, Artificial Sequence
  Description of Artificial Sequence: Synthetic peptide
AASSLQS

SEQ ID NO: 761 - protein, 7 aa, Artificial Sequence
  Description of Artificial Sequence: Synthetic peptide
AASSLQS

SEQ ID NO: 762 - protein, 7 aa, Artificial Sequence
  Description of Artificial Sequence: Synthetic peptide
AASSLQS

SEQ ID NO: 763 - protein, 7 aa, Artificial Sequence
  Description of Artificial Sequence: Synthetic peptide
AASSLQS

SEQ ID NO: 764 - protein, 7 aa, Artificial Sequence
  Description of Artificial Sequence: Synthetic peptide
AASSLQS

SEQ ID NO: 765 - protein, 7 aa, Artificial Sequence
  Description of Artificial Sequence: Synthetic peptide
AASSLQS

SEQ ID NO: 766 - protein, 7 aa, Artificial Sequence
  Description of Artificial Sequence: Synthetic peptide
AASSLQS

SEQ ID NO: 767 - protein, 7 aa, Artificial Sequence
  Description of Artificial Sequence: Synthetic peptide
AASSLQS

SEQ ID NO: 768 - protein, 7 aa, Artificial Sequence
  Description of Artificial Sequence: Synthetic peptide
AASSLQS

SEQ ID NO: 769 - protein, 7 aa, Artificial Sequence
  Description of Artificial Sequence: Synthetic peptide
AASSLQS

SEQ ID NO: 770 - protein, 7 aa, Artificial Sequence
  Description of Artificial Sequence: Synthetic peptide
AASSLQS

SEQ ID NO: 771 - protein, 7 aa, Artificial Sequence
  Description of Artificial Sequence: Synthetic peptide
AASSLQS

SEQ ID NO: 772 - protein, 7 aa, Artificial Sequence
  Description of Artificial Sequence: Synthetic peptide
AASSLQS

SEQ ID NO: 773 - protein, 7 aa, Artificial Sequence
  Description of Artificial Sequence: Synthetic peptide
AASSLQS

SEQ ID NO: 774 - protein, 7 aa, Artificial Sequence
  Description of Artificial Sequence: Synthetic peptide
AASSLQS

SEQ ID NO: 775 - protein, 7 aa, Artificial Sequence
  Description of Artificial Sequence: Synthetic peptide
AASSLQS

SEQ ID NO: 776 - protein, 32 aa, Artificial Sequence; identical to SEQ ID NO: 186
  Description of Artificial Sequence: Synthetic polypeptide

SEQ ID NO: 777 - protein, 32 aa, Artificial Sequence; identical to SEQ ID NO: 186
  Description of Artificial Sequence: Synthetic polypeptide

SEQ ID NO: 778 - protein, 32 aa, Artificial Sequence; identical to SEQ ID NO: 186
  Description of Artificial Sequence: Synthetic polypeptide

SEQ ID NO: 779 - protein, 32 aa, Artificial Sequence; identical to SEQ ID NO: 186
  Description of Artificial Sequence: Synthetic polypeptide

SEQ ID NO: 780 - protein, 32 aa, Artificial Sequence; identical to SEQ ID NO: 186
  Description of Artificial Sequence: Synthetic polypeptide

SEQ ID NO: 781 - protein, 32 aa, Artificial Sequence; identical to SEQ ID NO: 186
  Description of Artificial Sequence: Synthetic polypeptide

SEQ ID NO: 782 - protein, 32 aa, Artificial Sequence; identical to SEQ ID NO: 186
  Description of Artificial Sequence: Synthetic polypeptide

SEQ ID NO: 783 - protein, 32 aa, Artificial Sequence; identical to SEQ ID NO: 186
  Description of Artificial Sequence: Synthetic polypeptide

SEQ ID NO: 784 - protein, 32 aa, Artificial Sequence; identical to SEQ ID NO: 186
  Description of Artificial Sequence: Synthetic polypeptide

SEQ ID NO: 785 - protein, 32 aa, Artificial Sequence; identical to SEQ ID NO: 186
  Description of Artificial Sequence: Synthetic polypeptide

SEQ ID NO: 786 - protein, 32 aa, Artificial Sequence; identical to SEQ ID NO: 186
  Description of Artificial Sequence: Synthetic polypeptide

SEQ ID NO: 787 - protein, 32 aa, Artificial Sequence; identical to SEQ ID NO: 186
  Description of Artificial Sequence: Synthetic polypeptide

SEQ ID NO: 788 - protein, 32 aa, Artificial Sequence; identical to SEQ ID NO: 186
  Description of Artificial Sequence: Synthetic polypeptide

SEQ ID NO: 789 - protein, 32 aa, Artificial Sequence; identical to SEQ ID NO: 186
  Description of Artificial Sequence: Synthetic polypeptide

SEQ ID NO: 790 - protein, 32 aa, Artificial Sequence; identical to SEQ ID NO: 186
  Description of Artificial Sequence: Synthetic polypeptide

SEQ ID NO: 791 - protein, 32 aa, Artificial Sequence; identical to SEQ ID NO: 186
  Description of Artificial Sequence: Synthetic polypeptide

SEQ ID NO: 792 - protein, 32 aa, Artificial Sequence; identical to SEQ ID NO: 186
  Description of Artificial Sequence: Synthetic polypeptide

SEQ ID NO: 793 - protein, 32 aa, Artificial Sequence; identical to SEQ ID NO: 186
  Description of Artificial Sequence: Synthetic polypeptide

SEQ ID NO: 794 - protein, 32 aa, Artificial Sequence; identical to SEQ ID NO: 186
  Description of Artificial Sequence: Synthetic polypeptide

SEQ ID NO: 795 - protein, 32 aa, Artificial Sequence; identical to SEQ ID NO: 186
  Description of Artificial Sequence: Synthetic polypeptide

SEQ ID NO: 796 - protein, 32 aa, Artificial Sequence; identical to SEQ ID NO: 186
  Description of Artificial Sequence: Synthetic polypeptide

SEQ ID NO: 797 - protein, 32 aa, Artificial Sequence; identical to SEQ ID NO: 186
  Description of Artificial Sequence: Synthetic polypeptide

SEQ ID NO: 798 - protein, 32 aa, Artificial Sequence; identical to SEQ ID NO: 186
  Description of Artificial Sequence: Synthetic polypeptide

SEQ ID NO: 799 - protein, 32 aa, Artificial Sequence; identical to SEQ ID NO: 186
  Description of Artificial Sequence: Synthetic polypeptide

SEQ ID NO: 800 - protein, 32 aa, Artificial Sequence; identical to SEQ ID NO: 186
  Description of Artificial Sequence: Synthetic polypeptide

SEQ ID NO: 801 - protein, 5 aa, Artificial Sequence
  Description of Artificial Sequence: Synthetic peptide
QQAGI

SEQ ID NO: 802 - protein, 5 aa, Artificial Sequence
  Description of Artificial Sequence: Synthetic peptide
QQAGI

SEQ ID NO: 803 - protein, 5 aa, Artificial Sequence
  Description of Artificial Sequence: Synthetic peptide
QQAGI

SEQ ID NO: 804 - protein, 5 aa, Artificial Sequence
  Description of Artificial Sequence: Synthetic peptide
QQAGI

SEQ ID NO: 805 - protein, 5 aa, Artificial Sequence
  Description of Artificial Sequence: Synthetic peptide
QQAGI

SEQ ID NO: 806 - protein, 5 aa, Artificial Sequence
  Description of Artificial Sequence: Synthetic peptide
QQAGI

SEQ ID NO: 807 - protein, 5 aa, Artificial Sequence
  Description of Artificial Sequence: Synthetic peptide
QQAGI

SEQ ID NO: 808 - protein, 5 aa, Artificial Sequence
  Description of Artificial Sequence: Synthetic peptide
QQAGI

SEQ ID NO: 809 - protein, 5 aa, Artificial Sequence
  Description of Artificial Sequence: Synthetic peptide
QQAGI

SEQ ID NO: 810 - protein, 5 aa, Artificial Sequence
  Description of Artificial Sequence: Synthetic peptide
QQAGI

SEQ ID NO: 811 - protein, 5 aa, Artificial Sequence
  Description of Artificial Sequence: Synthetic peptide
QQAGI

SEQ ID NO: 812 - protein, 5 aa, Artificial Sequence
  Description of Artificial Sequence: Synthetic peptide
QQAGI

SEQ ID NO: 813 - protein, 5 aa, Artificial Sequence
  Description of Artificial Sequence: Synthetic peptide
QQAGI

SEQ ID NO: 814 - protein, 5 aa, Artificial Sequence
  Description of Artificial Sequence: Synthetic peptide
QQAGI

SEQ ID NO: 815 - protein, 5 aa, Artificial Sequence
  Description of Artificial Sequence: Synthetic peptide
QQAGI

SEQ ID NO: 816 - protein, 5 aa, Artificial Sequence
  Description of Artificial Sequence: Synthetic peptide
QQAGI

SEQ ID NO: 817 - protein, 5 aa, Artificial Sequence
  Description of Artificial Sequence: Synthetic peptide
QQAGI

SEQ ID NO: 818 - protein, 5 aa, Artificial Sequence
  Description of Artificial Sequence: Synthetic peptide
QQAGI

SEQ ID NO: 819 - protein, 5 aa, Artificial Sequence
  Description of Artificial Sequence: Synthetic peptide
QQAGI

SEQ ID NO: 820 - protein, 5 aa, Artificial Sequence
  Description of Artificial Sequence: Synthetic peptide
QQAGI

SEQ ID NO: 821 - protein, 5 aa, Artificial Sequence
  Description of Artificial Sequence: Synthetic peptide
QQAGI

SEQ ID NO: 822 - protein, 5 aa, Artificial Sequence
  Description of Artificial Sequence: Synthetic peptide
QQAGI

SEQ ID NO: 823 - protein, 5 aa, Artificial Sequence
  Description of Artificial Sequence: Synthetic peptide
QQAGI

SEQ ID NO: 824 - protein, 5 aa, Artificial Sequence
  Description of Artificial Sequence: Synthetic peptide
QQAGI

SEQ ID NO: 825 - protein, 5 aa, Artificial Sequence
  Description of Artificial Sequence: Synthetic peptide
QQAGI

SEQ ID NO: 826 - protein, 10 aa, Artificial Sequence
  Description of Artificial Sequence: Synthetic peptide
FGQGTKLEIK

SEQ ID NO: 827 - protein, 10 aa, Artificial Sequence
  Description of Artificial Sequence: Synthetic peptide
FGQGTKLEIK

SEQ ID NO: 828 - protein, 10 aa, Artificial Sequence
  Description of Artificial Sequence: Synthetic peptide
FGQGTKLEIK

SEQ ID NO: 829 - protein, 10 aa, Artificial Sequence
  Description of Artificial Sequence: Synthetic peptide
FGQGTKLEIK

SEQ ID NO: 830 - protein, 10 aa, Artificial Sequence
  Description of Artificial Sequence: Synthetic peptide
FGQGTKLEIK

SEQ ID NO: 831 - protein, 10 aa, Artificial Sequence
  Description of Artificial Sequence: Synthetic peptide
FGQGTKLEIK

SEQ ID NO: 832 - protein, 10 aa, Artificial Sequence
  Description of Artificial Sequence: Synthetic peptide
FGQGTKLEIK

SEQ ID NO: 833 - protein, 10 aa, Artificial Sequence
  Description of Artificial Sequence: Synthetic peptide
FGQGTKLEIK

SEQ ID NO: 834 - protein, 10 aa, Artificial Sequence
  Description of Artificial Sequence: Synthetic peptide
FGQGTKLEIK

SEQ ID NO: 835 - protein, 10 aa, Artificial Sequence
  Description of Artificial Sequence: Synthetic peptide
FGQGTKLEIK

SEQ ID NO: 836 - protein, 10 aa, Artificial Sequence
  Description of Artificial Sequence: Synthetic peptide
FGQGTKLEIK

SEQ ID NO: 837 - protein, 10 aa, Artificial Sequence
  Description of Artificial Sequence: Synthetic peptide
FGQGTKLEIK

SEQ ID NO: 838 - protein, 10 aa, Artificial Sequence
  Description of Artificial Sequence: Synthetic peptide
FGQGTKLEIK

SEQ ID NO: 839 - protein, 10 aa, Artificial Sequence
  Description of Artificial Sequence: Synthetic peptide
FGQGTKLEIK

SEQ ID NO: 840 - protein, 10 aa, Artificial Sequence
  Description of Artificial Sequence: Synthetic peptide
FGQGTKLEIK

SEQ ID NO: 841 - protein, 10 aa, Artificial Sequence
  Description of Artificial Sequence: Synthetic peptide
FGQGTKLEIK

SEQ ID NO: 842 - protein, 10 aa, Artificial Sequence
  Description of Artificial Sequence: Synthetic peptide
FGQGTKLEIK

SEQ ID NO: 843 - protein, 10 aa, Artificial Sequence
  Description of Artificial Sequence: Synthetic peptide
FGQGTKLEIK

SEQ ID NO: 844 - protein, 10 aa, Artificial Sequence
  Description of Artificial Sequence: Synthetic peptide
FGQGTKLEIK

SEQ ID NO: 845 - protein, 10 aa, Artificial Sequence
  Description of Artificial Sequence: Synthetic peptide
FGQGTKLEIK

SEQ ID NO: 846 - protein, 10 aa, Artificial Sequence
  Description of Artificial Sequence: Synthetic peptide
FGQGTKLEIK

SEQ ID NO: 847 - protein, 10 aa, Artificial Sequence
  Description of Artificial Sequence: Synthetic peptide
FGQGTKLEIK

SEQ ID NO: 848 - protein, 10 aa, Artificial Sequence
  Description of Artificial Sequence: Synthetic peptide
FGQGTKLEIK

SEQ ID NO: 849 - protein, 10 aa, Artificial Sequence
  Description of Artificial Sequence: Synthetic peptide
FGQGTKLEIK

SEQ ID NO: 850 - protein, 10 aa, Artificial Sequence
  Description of Artificial Sequence: Synthetic peptide
FGQGTKLEIK

SEQ ID NO: 851 - protein, 30 aa, Artificial Sequence; identical to SEQ ID NO: 322
  Description of Artificial Sequence: Synthetic polypeptide

SEQ ID NO: 852 - protein, 30 aa, Artificial Sequence; identical to SEQ ID NO: 322
  Description of Artificial Sequence: Synthetic polypeptide

SEQ ID NO: 853 - protein, 30 aa, Artificial Sequence; identical to SEQ ID NO: 322
  Description of Artificial Sequence: Synthetic polypeptide

SEQ ID NO: 854 - protein, 30 aa, Artificial Sequence; identical to SEQ ID NO: 322
  Description of Artificial Sequence: Synthetic polypeptide

SEQ ID NO: 855 - protein, 30 aa, Artificial Sequence; identical to SEQ ID NO: 322
  Description of Artificial Sequence: Synthetic polypeptide

SEQ ID NO: 856 - protein, 30 aa, Artificial Sequence; identical to SEQ ID NO: 322
  Description of Artificial Sequence: Synthetic polypeptide

SEQ ID NO: 857 - protein, 30 aa, Artificial Sequence; identical to SEQ ID NO: 322
  Description of Artificial Sequence: Synthetic polypeptide

SEQ ID NO: 858 - protein, 30 aa, Artificial Sequence; identical to SEQ ID NO: 322
  Description of Artificial Sequence: Synthetic polypeptide

SEQ ID NO: 859 - protein, 30 aa, Artificial Sequence; identical to SEQ ID NO: 322
  Description of Artificial Sequence: Synthetic polypeptide

SEQ ID NO: 860 - protein, 30 aa, Artificial Sequence; identical to SEQ ID NO: 322
  Description of Artificial Sequence: Synthetic polypeptide

SEQ ID NO: 861 - protein, 30 aa, Artificial Sequence; identical to SEQ ID NO: 322
  Description of Artificial Sequence: Synthetic polypeptide

SEQ ID NO: 862 - protein, 30 aa, Artificial Sequence; identical to SEQ ID NO: 322
  Description of Artificial Sequence: Synthetic polypeptide

SEQ ID NO: 863 - protein, 30 aa, Artificial Sequence; identical to SEQ ID NO: 322
  Description of Artificial Sequence: Synthetic polypeptide

SEQ ID NO: 864 - protein, 30 aa, Artificial Sequence; identical to SEQ ID NO: 322
  Description of Artificial Sequence: Synthetic polypeptide

SEQ ID NO: 865 - protein, 30 aa, Artificial Sequence; identical to SEQ ID NO: 322
  Description of Artificial Sequence: Synthetic polypeptide

SEQ ID NO: 866 - protein, 30 aa, Artificial Sequence; identical to SEQ ID NO: 322
  Description of Artificial Sequence: Synthetic polypeptide

SEQ ID NO: 867 - protein, 30 aa, Artificial Sequence; identical to SEQ ID NO: 322
  Description of Artificial Sequence: Synthetic polypeptide

SEQ ID NO: 868 - protein, 30 aa, Artificial Sequence; identical to SEQ ID NO: 322
  Description of Artificial Sequence: Synthetic polypeptide

SEQ ID NO: 869 - protein, 30 aa, Artificial Sequence; identical to SEQ ID NO: 322
  Description of Artificial Sequence: Synthetic polypeptide

SEQ ID NO: 870 - protein, 30 aa, Artificial Sequence; identical to SEQ ID NO: 322
  Description of Artificial Sequence: Synthetic polypeptide

SEQ ID NO: 871 - protein, 30 aa, Artificial Sequence; identical to SEQ ID NO: 322
  Description of Artificial Sequence: Synthetic polypeptide

SEQ ID NO: 872 - protein, 30 aa, Artificial Sequence; identical to SEQ ID NO: 322
  Description of Artificial Sequence: Synthetic polypeptide

SEQ ID NO: 873 - protein, 30 aa, Artificial Sequence; identical to SEQ ID NO: 322
  Description of Artificial Sequence: Synthetic polypeptide

SEQ ID NO: 874 - protein, 30 aa, Artificial Sequence; identical to SEQ ID NO: 322
  Description of Artificial Sequence: Synthetic polypeptide

SEQ ID NO: 875 - protein, 30 aa, Artificial Sequence; identical to SEQ ID NO: 322
  Description of Artificial Sequence: Synthetic polypeptide

SEQ ID NO: 876 - protein, 5 aa, Artificial Sequence
  Description of Artificial Sequence: Synthetic peptide
PYWMH

SEQ ID NO: 877 - protein, 5 aa, Artificial Sequence
  Description of Artificial Sequence: Synthetic peptide
QYFMH

SEQ ID NO: 878 - protein, 5 aa, Artificial Sequence
  Description of Artificial Sequence: Synthetic peptide
PYWMH

SEQ ID NO: 879 - protein, 5 aa, Artificial Sequence
  Description of Artificial Sequence: Synthetic peptide
DYNMH

SEQ ID NO: 880 - protein, 5 aa, Artificial Sequence
  Description of Artificial Sequence: Synthetic peptide
WYWMH

SEQ ID NO: 881 - protein, 5 aa, Artificial Sequence
  Description of Artificial Sequence: Synthetic peptide
EYNMH

SEQ ID NO: 882 - protein, 5 aa, Artificial Sequence
  Description of Artificial Sequence: Synthetic peptide
EYNMH

SEQ ID NO: 883 - protein, 5 aa, Artificial Sequence
  Description of Artificial Sequence: Synthetic peptide
PYWMH

SEQ ID NO: 884 - protein, 5 aa, Artificial Sequence
  Description of Artificial Sequence: Synthetic peptide
EYNMH

SEQ ID NO: 885 - protein, 5 aa, Artificial Sequence
  Description of Artificial Sequence: Synthetic peptide
EYNMH

SEQ ID NO: 886 - protein, 5 aa, Artificial Sequence
  Description of Artificial Sequence: Synthetic peptide
PYWMH

SEQ ID NO: 887 - protein, 5 aa, Artificial Sequence
  Description of Artificial Sequence: Synthetic peptide
PYWMH

SEQ ID NO: 888 - protein, 5 aa, Artificial Sequence
  Description of Artificial Sequence: Synthetic peptide
WYWMH

SEQ ID NO: 889 - protein, 5 aa, Artificial Sequence
  Description of Artificial Sequence: Synthetic peptide
WYWMH

SEQ ID NO: 890 - protein, 5 aa, Artificial Sequence
  Description of Artificial Sequence: Synthetic peptide
PYWMH

SEQ ID NO: 891 - protein, 5 aa, Artificial Sequence
  Description of Artificial Sequence: Synthetic peptide
WYWMH

SEQ ID NO: 892 - protein, 5 aa, Artificial Sequence
  Description of Artificial Sequence: Synthetic peptide
YYNMH

SEQ ID NO: 893 - protein, 5 aa, Artificial Sequence
  Description of Artificial Sequence: Synthetic peptide
WYGMH

SEQ ID NO: 894 - protein, 5 aa, Artificial Sequence
  Description of Artificial Sequence: Synthetic peptide
YYNMH

SEQ ID NO: 895 - protein, 5 aa, Artificial Sequence
  Description of Artificial Sequence: Synthetic peptide
PYNMH

SEQ ID NO: 896 - protein, 5 aa, Artificial Sequence
  Description of Artificial Sequence: Synthetic peptide
PYWMH

SEQ ID NO: 897 - protein, 5 aa, Artificial Sequence
  Description of Artificial Sequence: Synthetic peptide
PYWMH

SEQ ID NO: 898 - protein, 5 aa, Artificial Sequence
  Description of Artificial Sequence: Synthetic peptide
AYWMH

SEQ ID NO: 899 - protein, 5 aa, Artificial Sequence
  Description of Artificial Sequence: Synthetic peptide
WYWMH

SEQ ID NO: 900 - protein, 5 aa, Artificial Sequence
  Description of Artificial Sequence: Synthetic peptide
PYWMH

SEQ ID NO: 901 - protein, 14 aa, Artificial Sequence
  Description of Artificial Sequence: Synthetic peptide
WVRQAPGKGLEWVS

SEQ ID NO: 902 - protein, 14 aa, Artificial Sequence
  Description of Artificial Sequence: Synthetic peptide
WVRQAPGKGLEWVS

SEQ ID NO: 903 - protein, 14 aa, Artificial Sequence
  Description of Artificial Sequence: Synthetic peptide
WVRQAPGKGLEWVS

SEQ ID NO: 904 - protein, 14 aa, Artificial Sequence
  Description of Artificial Sequence: Synthetic peptide
WVRQAPGKGLEWVS

SEQ ID NO: 905 - protein, 14 aa, Artificial Sequence
  Description of Artificial Sequence: Synthetic peptide
WVRQAPGKGLEWVS

SEQ ID NO: 906 - protein, 14 aa, Artificial Sequence
  Description of Artificial Sequence: Synthetic peptide
WVRQAPGKGLEWVS

SEQ ID NO: 907 - protein, 14 aa, Artificial Sequence
  Description of Artificial Sequence: Synthetic peptide
WVRQAPGKGLEWVS

SEQ ID NO: 908 - protein, 14 aa, Artificial Sequence
  Description of Artificial Sequence: Synthetic peptide
WVRQAPGKGLEWVS

SEQ ID NO: 909 - protein, 14 aa, Artificial Sequence
  Description of Artificial Sequence: Synthetic peptide
WVRQAPGKGLEWVS

SEQ ID NO: 910 - protein, 14 aa, Artificial Sequence
  Description of Artificial Sequence: Synthetic peptide
WVRQAPGKGLEWVS

SEQ ID NO: 911 - protein, 14 aa, Artificial Sequence
  Description of Artificial Sequence: Synthetic peptide
WVRQAPGKGLEWVS

SEQ ID NO: 912 - protein, 14 aa, Artificial Sequence
  Description of Artificial Sequence: Synthetic peptide
WVRQAPGKGLEWVS

SEQ ID NO: 913 - protein, 14 aa, Artificial Sequence
  Description of Artificial Sequence: Synthetic peptide
WVRQAPGKGLEWVS

SEQ ID NO: 914 - protein, 14 aa, Artificial Sequence
  Description of Artificial Sequence: Synthetic peptide
WVRQAPGKGLEWVS

SEQ ID NO: 915 - protein, 14 aa, Artificial Sequence
  Description of Artificial Sequence: Synthetic peptide
WVRQAPGKGLEWVS

SEQ ID NO: 916 - protein, 14 aa, Artificial Sequence
  Description of Artificial Sequence: Synthetic peptide
WVRQAPGKGLEWVS

SEQ ID NO: 917 - protein, 14 aa, Artificial Sequence
  Description of Artificial Sequence: Synthetic peptide
WVRQAPGKGLEWVS

SEQ ID NO: 918 - protein, 14 aa, Artificial Sequence
  Description of Artificial Sequence: Synthetic peptide
WVRQAPGKGLEWVS

SEQ ID NO: 919 - protein, 14 aa, Artificial Sequence
  Description of Artificial Sequence: Synthetic peptide
WVRQAPGKGLEWVS

SEQ ID NO: 920 - protein, 14 aa, Artificial Sequence
  Description of Artificial Sequence: Synthetic peptide
WVRQAPGKGLEWVS

SEQ ID NO: 921 - protein, 14 aa, Artificial Sequence
  Description of Artificial Sequence: Synthetic peptide
WVRQAPGKGLEWVS

SEQ ID NO: 922 - protein, 14 aa, Artificial Sequence
  Description of Artificial Sequence: Synthetic peptide
WVRQAPGKGLEWVS

SEQ ID NO: 923 - protein, 14 aa, Artificial Sequence
  Description of Artificial Sequence: Synthetic peptide
WVRQAPGKGLEWVS

SEQ ID NO: 924 - protein, 14 aa, Artificial Sequence
  Description of Artificial Sequence: Synthetic peptide
WVRQAPGKGLEWVS

SEQ ID NO: 925 - protein, 14 aa, Artificial Sequence
  Description of Artificial Sequence: Synthetic peptide
WVRQAPGKGLEWVS

SEQ ID NO: 926 - protein, 17 aa, Artificial Sequence
  Description of Artificial Sequence: Synthetic peptide
GISSSGGDTLYADSVKG

SEQ ID NO: 927 - protein, 17 aa, Artificial Sequence
  Description of Artificial Sequence: Synthetic peptide
GIYPSGGDTFYADSVKG

SEQ ID NO: 928 - protein, 17 aa, Artificial Sequence
  Description of Artificial Sequence: Synthetic peptide
GISSSGGDTLYADSVKG

SEQ ID NO: 929 - protein, 17 aa, Artificial Sequence
  Description of Artificial Sequence: Synthetic peptide
YIGPSGGYTHYADSVKG

SEQ ID NO: 930 - protein, 17 aa, Artificial Sequence
  Description of Artificial Sequence: Synthetic peptide
GIYSSGGDTIYADSVKG

SEQ ID NO: 931 - protein, 17 aa, Artificial Sequence
  Description of Artificial Sequence: Synthetic peptide
GIVPSGGLTHYADSVKG

SEQ ID NO: 932 - protein, 17 aa, Artificial Sequence
  Description of Artificial Sequence: Synthetic peptide
GIGPSGGPTMYADSVKG

SEQ ID NO: 933 - protein, 17 aa, Artificial Sequence
  Description of Artificial Sequence: Synthetic peptide
GIGPSGGPTFYADSVKG

SEQ ID NO: 934 - protein, 17 aa, Artificial Sequence
  Description of Artificial Sequence: Synthetic peptide
GIVPSGGLTHYADSVKG

SEQ ID NO: 935 - protein, 17 aa, Artificial Sequence
  Description of Artificial Sequence: Synthetic peptide
GIVPSGGLTHYADSVKG

SEQ ID NO: 936 - protein, 17 aa, Artificial Sequence
  Description of Artificial Sequence: Synthetic peptide
GISPSGGETIYADSVKG

SEQ ID NO: 937 - protein, 17 aa, Artificial Sequence
  Description of Artificial Sequence: Synthetic peptide
GISPSGGHTMYADSVKG

SEQ ID NO: 938 - protein, 17 aa, Artificial Sequence
  Description of Artificial Sequence: Synthetic peptide
GISPSGGMTMYADSVKG

SEQ ID NO: 939 - protein, 17 aa, Artificial Sequence
  Description of Artificial Sequence: Synthetic peptide
GISPSGGYTMYADSVKG

SEQ ID NO: 940 - protein, 17 aa, Artificial Sequence
  Description of Artificial Sequence: Synthetic peptide
GISPSGGNTLYADSVKG

SEQ ID NO: 941 - protein, 17 aa, Artificial Sequence
  Description of Artificial Sequence: Synthetic peptide
GISPSGGSTFYADSVKG

SEQ ID NO: 942 - protein, 17 aa, Artificial Sequence
  Description of Artificial Sequence: Synthetic peptide
GIGPSGGGTLYADSVKG

SEQ ID NO: 943 - protein, 17 aa, Artificial Sequence
  Description of Artificial Sequence: Synthetic peptide
GIVSSGGETFYADSVKG

SEQ ID NO: 944 - protein, 17 aa, Artificial Sequence
  Description of Artificial Sequence: Synthetic peptide
GISPSGGTTFYADSVKG

SEQ ID NO: 945 - protein, 17 aa, Artificial Sequence
  Description of Artificial Sequence: Synthetic peptide
GISPSGGNTMYADSVKG

SEQ ID NO: 946 - protein, 17 aa, Artificial Sequence
  Description of Artificial Sequence: Synthetic peptide
GISPSGGWTFYADSVKG

SEQ ID NO: 947 - protein, 17 aa, Artificial Sequence
  Description of Artificial Sequence: Synthetic peptide
GIGPSGGPTFYADSVKG

SEQ ID NO: 948 - protein, 17 aa, Artificial Sequence
  Description of Artificial Sequence: Synthetic peptide
GISPSGGLTFYADSVKG

SEQ ID NO: 949 - protein, 17 aa, Artificial Sequence
  Description of Artificial Sequence: Synthetic peptide
GISPSGGPTMYADSVKG

SEQ ID NO: 950 - protein, 17 aa, Artificial Sequence
  Description of Artificial Sequence: Synthetic peptide
GIGPSGGLTFYADSVKG

SEQ ID NO: 951 - protein, 32 aa, Artificial Sequence
  Description of Artificial Sequence: Synthetic polypeptide
RFTISRDNSKNTLYLQMNGLRAEDTAVYYCAR

SEQ ID NO: 952 - protein, 32 aa, Artificial Sequence
  Description of Artificial Sequence: Synthetic polypeptide
RFTISRDNSKNTLYLQMNSLRAEDTAVYYCAR

SEQ ID NO: 953 - protein, 32 aa, Artificial Sequence; identical to SEQ ID NO: 951
  Description of Artificial Sequence: Synthetic polypeptide

SEQ ID NO: 954 - protein, 32 aa, Artificial Sequence; identical to SEQ ID NO: 952
  Description of Artificial Sequence: Synthetic polypeptide

SEQ ID NO: 955 - protein, 32 aa, Artificial Sequence; identical to SEQ ID NO: 458
  Description of Artificial Sequence: Synthetic polypeptide

SEQ ID NO: 956 - protein, 32 aa, Artificial Sequence; identical to SEQ ID NO: 458
  Description of Artificial Sequence: Synthetic polypeptide

SEQ ID NO: 957 - protein, 32 aa, Artificial Sequence; identical to SEQ ID NO: 458
  Description of Artificial Sequence: Synthetic polypeptide

SEQ ID NO: 958 - protein, 32 aa, Artificial Sequence; identical to SEQ ID NO: 952
  Description of Artificial Sequence: Synthetic polypeptide

SEQ ID NO: 959 - protein, 32 aa, Artificial Sequence; identical to SEQ ID NO: 458
  Description of Artificial Sequence: Synthetic polypeptide

SEQ ID NO: 960 - protein, 32 aa, Artificial Sequence; identical to SEQ ID NO: 952
  Description of Artificial Sequence: Synthetic polypeptide

SEQ ID NO: 961 - protein, 32 aa, Artificial Sequence; identical to SEQ ID NO: 952
  Description of Artificial Sequence: Synthetic polypeptide

SEQ ID NO: 962 - protein, 32 aa, Artificial Sequence; identical to SEQ ID NO: 458
  Description of Artificial Sequence: Synthetic polypeptide

SEQ ID NO: 963 - protein, 32 aa, Artificial Sequence; identical to SEQ ID NO: 952
  Description of Artificial Sequence: Synthetic polypeptide

SEQ ID NO: 964 - protein, 32 aa, Artificial Sequence; identical to SEQ ID NO: 458
  Description of Artificial Sequence: Synthetic polypeptide

SEQ ID NO: 965 - protein, 32 aa, Artificial Sequence; identical to SEQ ID NO: 952
  Description of Artificial Sequence: Synthetic polypeptide

SEQ ID NO: 966 - protein, 32 aa, Artificial Sequence; identical to SEQ ID NO: 952
  Description of Artificial Sequence: Synthetic polypeptide

SEQ ID NO: 967 - protein, 32 aa, Artificial Sequence; identical to SEQ ID NO: 952
  Description of Artificial Sequence: Synthetic polypeptide

SEQ ID NO: 968 - protein, 32 aa, Artificial Sequence; identical to SEQ ID NO: 458
  Description of Artificial Sequence: Synthetic polypeptide

SEQ ID NO: 969 - protein, 32 aa, Artificial Sequence; identical to SEQ ID NO: 952
  Description of Artificial Sequence: Synthetic polypeptide

SEQ ID NO: 970 - protein, 32 aa, Artificial Sequence; identical to SEQ ID NO: 952
  Description of Artificial Sequence: Synthetic polypeptide

SEQ ID NO: 971 - protein, 32 aa, Artificial Sequence; identical to SEQ ID NO: 952
  Description of Artificial Sequence: Synthetic polypeptide

SEQ ID NO: 972 - protein, 32 aa, Artificial Sequence; identical to SEQ ID NO: 458
  Description of Artificial Sequence: Synthetic polypeptide

SEQ ID NO: 973 - protein, 32 aa, Artificial Sequence
  Description of Artificial Sequence: Synthetic polypeptide
RFTISRDDSKNTLYLQMNSLGAEATAVYYCAR

SEQ ID NO: 974 - protein, 32 aa, Artificial Sequence; identical to SEQ ID NO: 458
  Description of Artificial Sequence: Synthetic polypeptide

SEQ ID NO: 975 - protein, 32 aa, Artificial Sequence; identical to SEQ ID NO: 952
  Description of Artificial Sequence: Synthetic polypeptide

SEQ ID NO: 976 - protein, 13 aa, Artificial Sequence
  Description of Artificial Sequence: Synthetic peptide
DIRGAYSSGLFFS

SEQ ID NO: 977 - protein, 13 aa, Artificial Sequence
  Description of Artificial Sequence: Synthetic peptide
DIRGAYSSGVFDY

SEQ ID NO: 978 - protein, 13 aa, Artificial Sequence
  Description of Artificial Sequence: Synthetic peptide
DIRGAYSSGLFFS

SEQ ID NO: 979 - protein, 13 aa, Artificial Sequence
  Description of Artificial Sequence: Synthetic peptide
DIRGAYASGLFDY

SEQ ID NO: 980 - protein, 13 aa, Artificial Sequence
  Description of Artificial Sequence: Synthetic peptide
DIRGPHSSGLFDY

SEQ ID NO: 981 - protein, 13 aa, Artificial Sequence
  Description of Artificial Sequence: Synthetic peptide
DIRGAYSSGLFDY

SEQ ID NO: 982 - protein, 13 aa, Artificial Sequence
  Description of Artificial Sequence: Synthetic peptide
DIRGAYSGGLFDY

SEQ ID NO: 983 - protein, 13 aa, Artificial Sequence
  Description of Artificial Sequence: Synthetic peptide
DIMGAYASGLFHN

SEQ ID NO: 984 - protein, 13 aa, Artificial Sequence
  Description of Artificial Sequence: Synthetic peptide
DIRGAYSSGLFDH

SEQ ID NO: 985 - protein, 13 aa, Artificial Sequence
  Description of Artificial Sequence: Synthetic peptide
DIRGAYSAGIFDY

SEQ ID NO: 986 - protein, 13 aa, Artificial Sequence
  Description of Artificial Sequence: Synthetic peptide
DIWGAYSAGHFEY

SEQ ID NO: 987 - protein, 13 aa, Artificial Sequence
  Description of Artificial Sequence: Synthetic peptide
DIRGAYSSGLFDF

SEQ ID NO: 988 - protein, 13 aa, Artificial Sequence
  Description of Artificial Sequence: Synthetic peptide
DIVGPYSAGLFDY

SEQ ID NO: 989 - protein, 13 aa, Artificial Sequence
  Description of Artificial Sequence: Synthetic peptide
DISGAYSSGLFTF

SEQ ID NO: 990 - protein, 13 aa, Artificial Sequence
  Description of Artificial Sequence: Synthetic peptide
DIRGAYSSGLFYD

SEQ ID NO: 991 - protein, 13 aa, Artificial Sequence
  Description of Artificial Sequence: Synthetic peptide
DFSGAYSAGLFAY

SEQ ID NO: 992 - protein, 13 aa, Artificial Sequence
  Description of Artificial Sequence: Synthetic peptide
DLSGEYASGLFGY

SEQ ID NO: 993 - protein, 13 aa, Artificial Sequence
  Description of Artificial Sequence: Synthetic peptide
DIRGVFLSGLFDH

SEQ ID NO: 994 - protein, 13 aa, Artificial Sequence
  Description of Artificial Sequence: Synthetic peptide
DITGAYSAGLFDL

SEQ ID NO: 995 - protein, 13 aa, Artificial Sequence
  Description of Artificial Sequence: Synthetic peptide
DIWGAYASGLFDY

SEQ ID NO: 996 - protein, 13 aa, Artificial Sequence
  Description of Artificial Sequence: Synthetic peptide
DIRGAYSSGMFDF

SEQ ID NO: 997 - protein, 13 aa, Artificial Sequence
  Description of Artificial Sequence: Synthetic peptide
DIRGAYSGGLFDY

SEQ ID NO: 998 - protein, 13 aa, Artificial Sequence
  Description of Artificial Sequence: Synthetic peptide
DIRGAYSSGHFDY

SEQ ID NO: 999 - protein, 13 aa, Artificial Sequence
  Description of Artificial Sequence: Synthetic peptide
DIRGPYSSGLFDY

SEQ ID NO: 1000 - protein, 13 aa, Artificial Sequence
  Description of Artificial Sequence: Synthetic peptide
DMRGAYASGLFDY

SEQ ID NO: 1001 - protein, 11 aa, Artificial Sequence
  Description of Artificial Sequence: Synthetic peptide
WGRGTLVTVSS

SEQ ID NO: 1002 - protein, 11 aa, Artificial Sequence
  Description of Artificial Sequence: Synthetic peptide
WGRGTLVTVSS

SEQ ID NO: 1003 - protein, 11 aa, Artificial Sequence
  Description of Artificial Sequence: Synthetic peptide
WGRGTLVTVSS

SEQ ID NO: 1004 - protein, 11 aa, Artificial Sequence
  Description of Artificial Sequence: Synthetic peptide
WGRGTLVTVSS

SEQ ID NO: 1005 - protein, 11 aa, Artificial Sequence
  Description of Artificial Sequence: Synthetic peptide
WGRGTLVTVSS

SEQ ID NO: 1006 - protein, 11 aa, Artificial Sequence
  Description of Artificial Sequence: Synthetic peptide
WGRGTLVTVSS

SEQ ID NO: 1007 - protein, 11 aa, Artificial Sequence
  Description of Artificial Sequence: Synthetic peptide
WGRGTLVTVSS

SEQ ID NO: 1008 - protein, 11 aa, Artificial Sequence
  Description of Artificial Sequence: Synthetic peptide
WGRGTLVTVSS

SEQ ID NO: 1009 - protein, 11 aa, Artificial Sequence
  Description of Artificial Sequence: Synthetic peptide
WGRGTLVTVSS

SEQ ID NO: 1010 - protein, 11 aa, Artificial Sequence
  Description of Artificial Sequence: Synthetic peptide
WGRGTLVTVSS

SEQ ID NO: 1011 - protein, 11 aa, Artificial Sequence
  Description of Artificial Sequence: Synthetic peptide
WGRGTLVTVSS

SEQ ID NO: 1012 - protein, 11 aa, Artificial Sequence
  Description of Artificial Sequence: Synthetic peptide
WGRGTLVTVSS

SEQ ID NO: 1013 - protein, 11 aa, Artificial Sequence
  Description of Artificial Sequence: Synthetic peptide
WGRGTLVTVSS

SEQ ID NO: 1014 - protein, 11 aa, Artificial Sequence
  Description of Artificial Sequence: Synthetic peptide
WGRGTLVTVSS

SEQ ID NO: 1015 - protein, 11 aa, Artificial Sequence
  Description of Artificial Sequence: Synthetic peptide
WGRGTLVTVSS

SEQ ID NO: 1016 - protein, 11 aa, Artificial Sequence
  Description of Artificial Sequence: Synthetic peptide
WGRGTLVTVSS

SEQ ID NO: 1017 - protein, 11 aa, Artificial Sequence
  Description of Artificial Sequence: Synthetic peptide
WGRGTLVTVSS

SEQ ID NO: 1018 - protein, 11 aa, Artificial Sequence
  Description of Artificial Sequence: Synthetic peptide
WGRGTLVTVSS

SEQ ID NO: 1019 - protein, 11 aa, Artificial Sequence
  Description of Artificial Sequence: Synthetic peptide
WGRGTLVTVSS

SEQ ID NO: 1020 - protein, 11 aa, Artificial Sequence
  Description of Artificial Sequence: Synthetic peptide
WGRGTLVTVSS

SEQ ID NO: 1021 - protein, 11 aa, Artificial Sequence
  Description of Artificial Sequence: Synthetic peptide
WGRGTLVTVSS

SEQ ID NO: 1022 - protein, 11 aa, Artificial Sequence
  Description of Artificial Sequence: Synthetic peptide
WGRGTLVTVSS

SEQ ID NO: 1023 - protein, 11 aa, Artificial Sequence
  Description of Artificial Sequence: Synthetic peptide
WGRGTLVTVSS

SEQ ID NO: 1024 - protein, 11 aa, Artificial Sequence
  Description of Artificial Sequence: Synthetic peptide
WGRGTLVTVSS

SEQ ID NO: 1025 - protein, 11 aa, Artificial Sequence
  Description of Artificial Sequence: Synthetic peptide
WGRGTLVTVSS

SEQ ID NO: 1026 - protein, 104 aa, Artificial Sequence; identical to SEQ ID NO: 608
  Description of Artificial Sequence: Synthetic polypeptide

SEQ ID NO: 1027 - protein, 104 aa, Artificial Sequence; identical to SEQ ID NO: 608
  Description of Artificial Sequence: Synthetic polypeptide

SEQ ID NO: 1028 - protein, 104 aa, Artificial Sequence; identical to SEQ ID NO: 608
  Description of Artificial Sequence: Synthetic polypeptide

SEQ ID NO: 1029 - protein, 104 aa, Artificial Sequence; identical to SEQ ID NO: 608
  Description of Artificial Sequence: Synthetic polypeptide

SEQ ID NO: 1030 - protein, 104 aa, Artificial Sequence; identical to SEQ ID NO: 608
  Description of Artificial Sequence: Synthetic polypeptide

SEQ ID NO: 1031 - protein, 104 aa, Artificial Sequence; identical to SEQ ID NO: 608
  Description of Artificial Sequence: Synthetic polypeptide

SEQ ID NO: 1032 - protein, 104 aa, Artificial Sequence; identical to SEQ ID NO: 608
  Description of Artificial Sequence: Synthetic polypeptide

SEQ ID NO: 1033 - protein, 104 aa, Artificial Sequence; identical to SEQ ID NO: 608
  Description of Artificial Sequence: Synthetic polypeptide

SEQ ID NO: 1034 - protein, 104 aa, Artificial Sequence; identical to SEQ ID NO: 608
  Description of Artificial Sequence: Synthetic polypeptide

SEQ ID NO: 1035 - protein, 104 aa, Artificial Sequence; identical to SEQ ID NO: 608
  Description of Artificial Sequence: Synthetic polypeptide

SEQ ID NO: 1036 - protein, 104 aa, Artificial Sequence; identical to SEQ ID NO: 608
  Description of Artificial Sequence: Synthetic polypeptide

SEQ ID NO: 1037 - protein, 104 aa, Artificial Sequence; identical to SEQ ID NO: 608
  Description of Artificial Sequence: Synthetic polypeptide

SEQ ID NO: 1038 - protein, 104 aa, Artificial Sequence; identical to SEQ ID NO: 608
  Description of Artificial Sequence: Synthetic polypeptide

SEQ ID NO: 1039 - protein, 104 aa, Artificial Sequence; identical to SEQ ID NO: 608
  Description of Artificial Sequence: Synthetic polypeptide

SEQ ID NO: 1040 - protein, 104 aa, Artificial Sequence; identical to SEQ ID NO: 608
  Description of Artificial Sequence: Synthetic polypeptide

SEQ ID NO: 1041 - protein, 104 aa, Artificial Sequence; identical to SEQ ID NO: 608
  Description of Artificial Sequence: Synthetic polypeptide

SEQ ID NO: 1042 - protein, 104 aa, Artificial Sequence; identical to SEQ ID NO: 608
  Description of Artificial Sequence: Synthetic polypeptide

SEQ ID NO: 1043 - protein, 104 aa, Artificial Sequence; identical to SEQ ID NO: 608
  Description of Artificial Sequence: Synthetic polypeptide

SEQ ID NO: 1044 - protein, 104 aa, Artificial Sequence; identical to SEQ ID NO: 608
  Description of Artificial Sequence: Synthetic polypeptide

SEQ ID NO: 1045 - protein, 104 aa, Artificial Sequence; identical to SEQ ID NO: 608
  Description of Artificial Sequence: Synthetic polypeptide

SEQ ID NO: 1046 - protein, 104 aa, Artificial Sequence; identical to SEQ ID NO: 608
  Description of Artificial Sequence: Synthetic polypeptide

SEQ ID NO: 1047 - protein, 104 aa, Artificial Sequence; identical to SEQ ID NO: 608
  Description of Artificial Sequence: Synthetic polypeptide

SEQ ID NO: 1048 - protein, 104 aa, Artificial Sequence; identical to SEQ ID NO: 608
  Description of Artificial Sequence: Synthetic polypeptide

SEQ ID NO: 1049 - protein, 104 aa, Artificial Sequence; identical to SEQ ID NO: 608
  Description of Artificial Sequence: Synthetic polypeptide

SEQ ID NO: 1050 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGISSSGGDTLYADSVKGRFTISRDNSKNTLYLQMNGLRAEDTAVYYCARDIRGAYSSGLFFSWGRGTLVTVSS

SEQ ID NO: 1051 - protein, 122 aa, Artificial Sequence
  Description of Artificial Sequence: Synthetic polypeptide
EVQLLESGGGLVQPGGSLRLSCAASGFTFSQYFMHWVRQAPGKGLEWVSGIYPSGGDTFYADSVKGRFTISRDNSKNTLYLQMNSLRAEDTAVYYCARDIRGAYSSGVFDYWGRGTLVTVSS

SEQ ID NO: 1052 - protein, 122 aa, Artificial Sequence; identical to SEQ ID NO: 1050
  Description of Artificial Sequence: Synthetic polypeptide

SEQ ID NO: 1053 - protein, 122 aa, Artificial Sequence
  Description of Artificial Sequence: Synthetic polypeptide
EVQLLESGGGLVQPGGSLRLSCAASGFTFSDYNMHWVRQAPGKGLEWVSYIGPSGGYTHYADSVKGRFTISRDNSKNTLYLQMNSLRAEDTAVYYCARDIRGAYASGLFDYWGRGTLVTVSS

SEQ ID NO: 1054 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGIYSSGGDTIYADSVKGRFTISRDNSKNTLYLQMNSLRAEDTAVYYCAKDIRGPHSSGLFDYWGRGTLVTVSS

SEQ ID NO: 1055 - protein, 122 aa, Artificial Sequence
  Description of Artificial Sequence: Synthetic polypeptide
EVQLLESGGGLVQPGGSLRLSCAASGFTFSEYNMHWVRQAPGKGLEWVSGIVPSGGLTHYADSVKGRFTISRDNSKNTLYLQMNSLRAEDTAVYYCAKDIRGAYSSGLFDYWGRGTLVTVSS

SEQ ID NO: 1056 - protein, 122 aa, Artificial Sequence
  Description of Artificial Sequence: Synthetic polypeptide
EVQLLESGGGLVQPGGSLRLSCAASGFTFSEYNMHWVRQAPGKGLEWVSGIGPSGGPTMYADSVKGRFTISRDNSKNTLYLQMNSLRAEDTAVYYCAKDIRGAYSGGLFDYWGRGTLVTVSS

SEQ ID NO: 1057 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGIGPSGGPTFYADSVKGRFTISRDNSKNTLYLQMNSLRAEDTAVYYCARDIMGAYASGLFHNWGRGTLVTVSS

SEQ ID NO: 1058 - protein, 122 aa, Artificial Sequence
  Description of Artificial Sequence: Synthetic polypeptide
EVQLLESGGGLVQPGGSLRLSCAASGFTFSEYNMHWVRQAPGKGLEWVSGIVPSGGLTHYADSVKGRFTISRDNSKNTLYLQMNSLRAEDTAVYYCAKDIRGAYSSGLFDHWGRGTLVTVSS

SEQ ID NO: 1059 - protein, 122 aa, Artificial Sequence
  Description of Artificial Sequence: Synthetic polypeptide
EVQLLESGGGLVQPGGSLRLSCAASGFTFSEYNMHWVRQAPGKGLEWVSGIVPSGGLTHYADSVKGRFTISRDNSKNTLYLQMNSLRAEDTAVYYCARDIRGAYSAGIFDYWGRGTLVTVSS

SEQ ID NO: 1060 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGISPSGGETIYADSVKGRFTISRDNSKNTLYLQMNSLRAEDTAVYYCARDIWGAYSAGHFEYWGRGTLVTVSS

SEQ ID NO: 1061 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGISPSGGHTMYADSVKGRFTISRDNSKNTLYLQMNSLRAEDTAVYYCAKDIRGAYSSGLFDFWGRGTLVTVSS

SEQ ID NO: 1062 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGISPSGGMTMYADSVKGRFTISRDNSKNTLYLQMNSLRAEDTAVYYCARDIVGPYSAGLFDYWGRGTLVTVSS

SEQ ID NO: 1063 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGISPSGGYTMYADSVKGRFTISRDNSKNTLYLQMNSLRAEDTAVYYCAKDISGAYSSGLFTFWGRGTLVTVSS

SEQ ID NO: 1064 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGISPSGGNTLYADSVKGRFTISRDNSKNTLYLQMNSLRAEDTAVYYCARDIRGAYSSGLFYDWGRGTLVTVSS

SEQ ID NO: 1065 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGISPSGGSTFYADSVKGRFTISRDNSKNTLYLQMNSLRAEDTAVYYCARDFSGAYSAGLFAYWGRGTLVTVSS

SEQ ID NO: 1066 - protein, 122 aa, Artificial Sequence
  Description of Artificial Sequence: Synthetic polypeptide
EVQLLESGGGLVQPGGSLRLSCAASGFTFSYYNMHWVRQAPGKGLEWVSGIGPSGGGTLYADSVKGRFTISRDNSKNTLYLQMNSLRAEDTAVYYCARDLSGEYASGLFGYWGRGTLVTVSS

SEQ ID NO: 1067 - protein, 122 aa, Artificial Sequence
  Description of Artificial Sequence: Synthetic polypeptide
EVQLLESGGGLVQPGGSLRLSCAASGFTFSWYGMHWVRQAPGKGLEWVSGIVSSGGETFYADSVKGRFTISRDNSKNTLYLQMNSLRAEDTAVYYCAKDIRGVFLSGLFDHWGRGTLVTVSS

SEQ ID NO: 1068 - protein, 122 aa, Artificial Sequence
  Description of Artificial Sequence: Synthetic polypeptide
EVQLLESGGGLVQPGGSLRLSCAASGFTFSYYNMHWVRQAPGKGLEWVSGISPSGGTTFYADSVKGRFTISRDNSKNTLYLQMNSLRAEDTAVYYCARDITGAYSAGLFDLWGRGTLVTVSS

SEQ ID NO: 1069 - protein, 122 aa, Artificial Sequence
  Description of Artificial Sequence: Synthetic polypeptide
EVQLLESGGGLVQPGGSLRLSCAASGFTFSPYNMHWVRQAPGKGLEWVSGISPSGGNTMYADSVKGRFTISRDNSKNTLYLQMNSLRAEDTAVYYCARDIWGAYASGLFDYWGRGTLVTVSS

SEQ ID NO: 1070 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGISPSGGWTFYADSVKGRFTISRDNSKNTLYLQMNSLRAEDTAVYYCARDIRGAYSSGMFDFWGRGTLVTVSS

SEQ ID NO: 1071 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGIGPSGGPTFYADSVKGRFTISRDNSKNTLYLQMNSLRAEDTAVYYCAKDIRGAYSGGLFDYWGRGTLVTVSS

SEQ ID NO: 1072 - protein, 122 aa, Artificial Sequence
  Description of Artificial Sequence: Synthetic polypeptide
EVQLLESGGGLVQPGGSLRLSCAASGFTFSAYWMHWVRQAPGKGLEWVSGISPSGGLTFYADSVKGRFTISRDDSKNTLYLQMNSLGAEATAVYYCARDIRGAYSSGHFDYWGRGTLVTVSS

SEQ ID NO: 1073 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGISPSGGPTMYADSVKGRFTISRDNSKNTLYLQMNSLRAEDTAVYYCAKDIRGPYSSGLFDYWGRGTLVTVSS

SEQ ID NO: 1074 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGIGPSGGLTFYADSVKGRFTISRDNSKNTLYLQMNSLRAEDTAVYYCARDMRGAYASGLFDYWGRGTLVTVSS

SEQ ID NO: 1075 - protein, 24 aa, Artificial Sequence
  Description of Artificial Sequence: Synthetic peptide
QDIQMTQSPSSLSASVGDRVTITC

SEQ ID NO: 1076 - protein, 24 aa, Artificial Sequence
  Description of Artificial Sequence: Synthetic peptide
QDIQMTQSPSSLSASVGDRVTITC

SEQ ID NO: 1077 - protein, 24 aa, Artificial Sequence
  Description of Artificial Sequence: Synthetic peptide
QDIQMTQSPSSLSASVGDRVTITC

SEQ ID NO: 1078 - protein, 24 aa, Artificial Sequence
  Description of Artificial Sequence: Synthetic peptide
QDIQMTQSPSSLSASVGDRVTITC

SEQ ID NO: 1079 - protein, 24 aa, Artificial Sequence
  Description of Artificial Sequence: Synthetic peptide
QDIQMTQSPSSLSASVGDRVTITC

SEQ ID NO: 1080 - protein, 11 aa, Artificial Sequence
  Description of Artificial Sequence: Synthetic peptide
RASQNIFNYLN

SEQ ID NO: 1081 - protein, 11 aa, Artificial Sequence
  Description of Artificial Sequence: Synthetic peptide
RADQSIYTYLN

SEQ ID NO: 1082 - protein, 11 aa, Artificial Sequence
  Description of Artificial Sequence: Synthetic peptide
RAEQSIYTYLN

SEQ ID NO: 1083 - protein, 11 aa, Artificial Sequence
  Description of Artificial Sequence: Synthetic peptide
RATQSIYTYLN

SEQ ID NO: 1084 - protein, 11 aa, Artificial Sequence
  Description of Artificial Sequence: Synthetic peptide
RAVQSIYTYLN

SEQ ID NO: 1085 - protein, 15 aa, Artificial Sequence
  Description of Artificial Sequence: Synthetic peptide
WYQQRPGKAPKLLIY

SEQ ID NO: 1086 - protein, 15 aa, Artificial Sequence
  Description of Artificial Sequence: Synthetic peptide
WYQQKPGKAPKLLIY

SEQ ID NO: 1087 - protein, 15 aa, Artificial Sequence
  Description of Artificial Sequence: Synthetic peptide
WYQQKPGKAPKLLIY

SEQ ID NO: 1088 - protein, 15 aa, Artificial Sequence
  Description of Artificial Sequence: Synthetic peptide
WYQQKPGKAPKLLIY

SEQ ID NO: 1089 - protein, 15 aa, Artificial Sequence
  Description of Artificial Sequence: Synthetic peptide
WYQQKPGKAPKLLIY

SEQ ID NO: 1090 - protein, 7 aa, Artificial Sequence
  Description of Artificial Sequence: Synthetic peptide
AASNLQT

SEQ ID NO: 1091 - protein, 7 aa, Artificial Sequence
  Description of Artificial Sequence: Synthetic peptide
AASSLQS

SEQ ID NO: 1092 - protein, 7 aa, Artificial Sequence
  Description of Artificial Sequence: Synthetic peptide
AASSLQS

SEQ ID NO: 1093 - protein, 7 aa, Artificial Sequence
  Description of Artificial Sequence: Synthetic peptide
AASSLQS

SEQ ID NO: 1094 - protein, 7 aa, Artificial Sequence
  Description of Artificial Sequence: Synthetic peptide
AASSLQS

SEQ ID NO: 1095 - protein, 32 aa, Artificial Sequence
  Description of Artificial Sequence: Synthetic polypeptide
GVPSRFSGSGSGTDFIFTISSLQPEDIATYYC

SEQ ID NO: 1096 - protein, 32 aa, Artificial Sequence; identical to SEQ ID NO: 186
  Description of Artificial Sequence: Synthetic polypeptide

SEQ ID NO: 1097 - protein, 32 aa, Artificial Sequence; identical to SEQ ID NO: 186
  Description of Artificial Sequence: Synthetic polypeptide

SEQ ID NO: 1098 - protein, 32 aa, Artificial Sequence; identical to SEQ ID NO: 186
  Description of Artificial Sequence: Synthetic polypeptide

SEQ ID NO: 1099 - protein, 32 aa, Artificial Sequence; identical to SEQ ID NO: 186
  Description of Artificial Sequence: Synthetic polypeptide

SEQ ID NO: 1100 - protein, 5 aa, Artificial Sequence
  Description of Artificial Sequence: Synthetic peptide
QQAGI

SEQ ID NO: 1101 - protein, 5 aa, Artificial Sequence
  Description of Artificial Sequence: Synthetic peptide
QQAGI

SEQ ID NO: 1102 - protein, 5 aa, Artificial Sequence
  Description of Artificial Sequence: Synthetic peptide
QQAGI

SEQ ID NO: 1103 - protein, 5 aa, Artificial Sequence
  Description of Artificial Sequence: Synthetic peptide
QQAGI

SEQ ID NO: 1104 - protein, 5 aa, Artificial Sequence
  Description of Artificial Sequence: Synthetic peptide
QQAGI

SEQ ID NO: 1105 - protein, 10 aa, Artificial Sequence
  Description of Artificial Sequence: Synthetic peptide
FGQGTKLEIK

SEQ ID NO: 1106 - protein, 10 aa, Artificial Sequence
  Description of Artificial Sequence: Synthetic peptide
FGQGTKLEIK

SEQ ID NO: 1107 - protein, 10 aa, Artificial Sequence
  Description of Artificial Sequence: Synthetic peptide
FGQGTKLEIK

SEQ ID NO: 1108 - protein, 10 aa, Artificial Sequence
  Description of Artificial Sequence: Synthetic peptide
FGQGTKLEIK

SEQ ID NO: 1109 - protein, 10 aa, Artificial Sequence
  Description of Artificial Sequence: Synthetic peptide
FGQGTKLEIK

SEQ ID NO: 1110 - protein, 7 aa, Artificial Sequence
  Description of Artificial Sequence: Synthetic peptide
RTVAAPS

SEQ ID NO: 1111 - protein, 7 aa, Artificial Sequence
  Description of Artificial Sequence: Synthetic peptide
RTVAAPS

SEQ ID NO: 1112 - protein, 7 aa, Artificial Sequence
  Description of Artificial Sequence: Synthetic peptide
RTVAAPS

SEQ ID NO: 1113 - protein, 7 aa, Artificial Sequence
  Description of Artificial Sequence: Synthetic peptide
RTVAAPS

SEQ ID NO: 1114 - protein, 7 aa, Artificial Sequence
  Description of Artificial Sequence: Synthetic peptide
RTVAAPS

SEQ ID NO: 1115 - protein, 30 aa, Artificial Sequence; identical to SEQ ID NO: 322
  Description of Artificial Sequence: Synthetic polypeptide

SEQ ID NO: 1116 - protein, 30 aa, Artificial Sequence; identical to SEQ ID NO: 322
  Description of Artificial Sequence: Synthetic polypeptide

SEQ ID NO: 1117 - protein, 30 aa, Artificial Sequence; identical to SEQ ID NO: 322
  Description of Artificial Sequence: Synthetic polypeptide

SEQ ID NO: 1118 - protein, 30 aa, Artificial Sequence; identical to SEQ ID NO: 322
  Description of Artificial Sequence: Synthetic polypeptide

SEQ ID NO: 1119 - protein, 30 aa, Artificial Sequence; identical to SEQ ID NO: 322
  Description of Artificial Sequence: Synthetic polypeptide

SEQ ID NO: 1120 - protein, 5 aa, Artificial Sequence
  Description of Artificial Sequence: Synthetic peptide
WYWMH

SEQ ID NO: 1121 - protein, 5 aa, Artificial Sequence
  Description of Artificial Sequence: Synthetic peptide
WYWMH

SEQ ID NO: 1122 - protein, 5 aa, Artificial Sequence
  Description of Artificial Sequence: Synthetic peptide
WYWMH

SEQ ID NO: 1123 - protein, 5 aa, Artificial Sequence
  Description of Artificial Sequence: Synthetic peptide
WYWMH

SEQ ID NO: 1124 - protein, 5 aa, Artificial Sequence
  Description of Artificial Sequence: Synthetic peptide
WYWMH

SEQ ID NO: 1125 - protein, 14 aa, Artificial Sequence
  Description of Artificial Sequence: Synthetic peptide
WVRQAPGKGLEWVS

SEQ ID NO: 1126 - protein, 14 aa, Artificial Sequence
  Description of Artificial Sequence: Synthetic peptide
WVRQAPGKGLEWVS

SEQ ID NO: 1127 - protein, 14 aa, Artificial Sequence
  Description of Artificial Sequence: Synthetic peptide
WVRQAPGKGLEWVS

SEQ ID NO: 1128 - protein, 14 aa, Artificial Sequence
  Description of Artificial Sequence: Synthetic peptide
WVRQAPGKGLEWVS

SEQ ID NO: 1129 - protein, 14 aa, Artificial Sequence
  Description of Artificial Sequence: Synthetic peptide
WVRQAPGKGLEWVS

SEQ ID NO: 1130 - protein, 17 aa, Artificial Sequence
  Description of Artificial Sequence: Synthetic peptide
GISPSGGMTMYADSVKG

SEQ ID NO: 1131 - protein, 17 aa, Artificial Sequence
  Description of Artificial Sequence: Synthetic peptide
GISPSGGMTMYADSVKG

SEQ ID NO: 1132 - protein, 17 aa, Artificial Sequence
  Description of Artificial Sequence: Synthetic peptide
GISPSGGMTMYADSVKG

SEQ ID NO: 1133 - protein, 17 aa, Artificial Sequence
  Description of Artificial Sequence: Synthetic peptide
GISPSGGMTMYADSVKG

SEQ ID NO: 1134 - protein, 17 aa, Artificial Sequence
  Description of Artificial Sequence: Synthetic peptide
GISPSGGMTMYADSVKG

SEQ ID NO: 1135 - protein, 32 aa, Artificial Sequence; identical to SEQ ID NO: 952
  Description of Artificial Sequence: Synthetic polypeptide

SEQ ID NO: 1136 - protein, 32 aa, Artificial Sequence; identical to SEQ ID NO: 952
  Description of Artificial Sequence: Synthetic polypeptide

SEQ ID NO: 1137 - protein, 32 aa, Artificial Sequence; identical to SEQ ID NO: 952
  Description of Artificial Sequence: Synthetic polypeptide

SEQ ID NO: 1138 - protein, 32 aa, Artificial Sequence; identical to SEQ ID NO: 952
  Description of Artificial Sequence: Synthetic polypeptide

SEQ ID NO: 1139 - protein, 32 aa, Artificial Sequence; identical to SEQ ID NO: 952
  Description of Artificial Sequence: Synthetic polypeptide

SEQ ID NO: 1140 - protein, 13 aa, Artificial Sequence
  Description of Artificial Sequence: Synthetic peptide
DIVGPYSAGLFDY

SEQ ID NO: 1141 - protein, 13 aa, Artificial Sequence
  Description of Artificial Sequence: Synthetic peptide
DIVGPYSAGLFDY

SEQ ID NO: 1142 - protein, 13 aa, Artificial Sequence
  Description of Artificial Sequence: Synthetic peptide
DIVGPYSAGLFDY

SEQ ID NO: 1143 - protein, 13 aa, Artificial Sequence
  Description of Artificial Sequence: Synthetic peptide
DIVGPYSAGLFDY

SEQ ID NO: 1144 - protein, 13 aa, Artificial Sequence
  Description of Artificial Sequence: Synthetic peptide
DIVGPYSAGLFDY

SEQ ID NO: 1145 - protein, 11 aa, Artificial Sequence
  Description of Artificial Sequence: Synthetic peptide
WGRGTLVTVSS

SEQ ID NO: 1146 - protein, 11 aa, Artificial Sequence
  Description of Artificial Sequence: Synthetic peptide
WGRGTLVTVSS

SEQ ID NO: 1147 - protein, 11 aa, Artificial Sequence
  Description of Artificial Sequence: Synthetic peptide
WGRGTLVTVSS

SEQ ID NO: 1148 - protein, 11 aa, Artificial Sequence
  Description of Artificial Sequence: Synthetic peptide
WGRGTLVTVSS

SEQ ID NO: 1149 - protein, 11 aa, Artificial Sequence
  Description of Artificial Sequence: Synthetic peptide
WGRGTLVTVSS

SEQ ID NO: 1150 - protein, 24 aa, Artificial Sequence
  Description of Artificial Sequence: Synthetic peptide
QDIQMTQSPSSLSASVGDRVTITC

SEQ ID NO: 1151 - protein, 24 aa, Artificial Sequence
  Description of Artificial Sequence: Synthetic peptide
QDIQMTQSPSSLSASVGDRVTITC

SEQ ID NO: 1152 - protein, 24 aa, Artificial Sequence
  Description of Artificial Sequence: Synthetic peptide
QDIQMTQSPSSLSASVGDRVTITC

SEQ ID NO: 1153 - protein, 24 aa, Artificial Sequence
  Description of Artificial Sequence: Synthetic peptide
QDIQMTQSPSSLSASVGDRVTITC

SEQ ID NO: 1154 - protein, 24 aa, Artificial Sequence
  Description of Artificial Sequence: Synthetic peptide
QDIQMTQSPSSLSASVGDRVTITC

SEQ ID NO: 1155 - protein, 24 aa, Artificial Sequence
  Description of Artificial Sequence: Synthetic peptide
QDIQMTQSPSSLSASVGDRVTITC

SEQ ID NO: 1156 - protein, 24 aa, Artificial Sequence
  Description of Artificial Sequence: Synthetic peptide
QDIQMTQSPSSLSASVGDRVTITC

SEQ ID NO: 1157 - protein, 24 aa, Artificial Sequence
  Description of Artificial Sequence: Synthetic peptide
QDIQMTQSPSSLSASVGDRVTITC

SEQ ID NO: 1158 - protein, 24 aa, Artificial Sequence
  Description of Artificial Sequence: Synthetic peptide
QDIQMTQSPSSLSASVGDRVTITC

SEQ ID NO: 1159 - protein, 24 aa, Artificial Sequence
  Description of Artificial Sequence: Synthetic peptide
QDIQMTQSPSSLSASVGDRVTITC

SEQ ID NO: 1160 - protein, 24 aa, Artificial Sequence
  Description of Artificial Sequence: Synthetic peptide
QDIQMTQSPSSLSASVGDRVTITC

SEQ ID NO: 1161 - protein, 24 aa, Artificial Sequence
  Description of Artificial Sequence: Synthetic peptide
QDIQMTQSPSSLSASVGDRVTITC

SEQ ID NO: 1162 - protein, 24 aa, Artificial Sequence
  Description of Artificial Sequence: Synthetic peptide
QDIQMTQSPSSLSASVGDRVTITC

SEQ ID NO: 1163 - protein, 24 aa, Artificial Sequence
  Description of Artificial Sequence: Synthetic peptide
QDIQMTQSPSSLSASVGDRVTITC

SEQ ID NO: 1164 - protein, 24 aa, Artificial Sequence
  Description of Artificial Sequence: Synthetic peptide
QDIQMTQSPSSLSASVGDRVTITC

SEQ ID NO: 1165 - protein, 24 aa, Artificial Sequence
  Description of Artificial Sequence: Synthetic peptide
QDIQMTQSPSSLSASVGDRVTITC

SEQ ID NO: 1166 - protein, 24 aa, Artificial Sequence
  Description of Artificial Sequence: Synthetic peptide
QDIQMTQSPSSLSASVGDRVTITC

SEQ ID NO: 1167 - protein, 24 aa, Artificial Sequence
  Description of Artificial Sequence: Synthetic peptide
QDIQMTQSPSSLSASVGDRVTITC

SEQ ID NO: 1168 - protein, 24 aa, Artificial Sequence
  Description of Artificial Sequence: Synthetic peptide
QDIQMTQSPSSLSASVGDRVTITC

SEQ ID NO: 1169 - protein, 24 aa, Artificial Sequence
  Description of Artificial Sequence: Synthetic peptide
QDIQMTQSPSSLSASVGDRVTITC

SEQ ID NO: 1170 - protein, 24 aa, Artificial Sequence
  Description of Artificial Sequence: Synthetic peptide
QDIQMTQSPSSLSASVGDRVTITC

SEQ ID NO: 1171 - protein, 24 aa, Artificial Sequence
  Description of Artificial Sequence: Synthetic peptide
QDIQMTQSPSSLSASVGDRVTITC

SEQ ID NO: 1172 - protein, 24 aa, Artificial Sequence
  Description of Artificial Sequence: Synthetic peptide
QDIQMTQSPSSLSASVGDRVTITC

SEQ ID NO: 1173 - protein, 24 aa, Artificial Sequence
  Description of Artificial Sequence: Synthetic peptide
QDIQMTQSPSSLSASVGDRVTITC

SEQ ID NO: 1174 - protein, 24 aa, Artificial Sequence
  Description of Artificial Sequence: Synthetic peptide
QDIQMTQSPSSLSASVGDRVTITC

SEQ ID NO: 1175 - protein, 24 aa, Artificial Sequence
  Description of Artificial Sequence: Synthetic peptide
QDIQMTQSPSSLSASVGDRVTITC

SEQ ID NO: 1176 - protein, 24 aa, Artificial Sequence
  Description of Artificial Sequence: Synthetic peptide
QDIQMTQSPSSLSASVGDRVTITC

SEQ ID NO: 1177 - protein, 24 aa, Artificial Sequence
  Description of Artificial Sequence: Synthetic peptide
QDIQMTQSPSSLSASVGDRVTITC

SEQ ID NO: 1178 - protein, 24 aa, Artificial Sequence
  Description of Artificial Sequence: Synthetic peptide
QDIQMTQSPSSLSASVGDRVTITC

SEQ ID NO: 1179 - protein, 24 aa, Artificial Sequence
  Description of Artificial Sequence: Synthetic peptide
QDIQMTQSPSSLSASVGDRVTITC

SEQ ID NO: 1180 - protein, 24 aa, Artificial Sequence
  Description of Artificial Sequence: Synthetic peptide
QDIQMTQSPSSLSASVGDRVTITC

SEQ ID NO: 1181 - protein, 24 aa, Artificial Sequence
  Description of Artificial Sequence: Synthetic peptide
QDIQMTQSPSSLSASVGDRVTITC

SEQ ID NO: 1182 - protein, 24 aa, Artificial Sequence
  Description of Artificial Sequence: Synthetic peptide
QDIQMTQSPSSLSASVGDRVTITC

SEQ ID NO: 1183 - protein, 24 aa, Artificial Sequence
  Description of Artificial Sequence: Synthetic peptide
QDIQMTQSPSSLSASVGDRVTITC

SEQ ID NO: 1184 - protein, 24 aa, Artificial Sequence
  Description of Artificial Sequence: Synthetic peptide
QDIQMTQSPSSLSASVGDRVTITC

SEQ ID NO: 1185 - protein, 24 aa, Artificial Sequence
  Description of Artificial Sequence: Synthetic peptide
QDIQMTQSPSSLSASVGDRVTITC

SEQ ID NO: 1186 - protein, 24 aa, Artificial Sequence
  Description of Artificial Sequence: Synthetic peptide
QDIQMTQSPSSLSASVGDRVTITC

SEQ ID NO: 1187 - protein, 24 aa, Artificial Sequence
  Description of Artificial Sequence: Synthetic peptide
QDIQMTQSPSSLSASVGDRVTITC

SEQ ID NO: 1188 - protein, 24 aa, Artificial Sequence
  Description of Artificial Sequence: Synthetic peptide
QDIQMTQSPSSLSASVGDRVTITC

SEQ ID NO: 1189 - protein, 24 aa, Artificial Sequence
  Description of Artificial Sequence: Synthetic peptide
QDIQMTQSPSSLSASVGDRVTITC

SEQ ID NO: 1190 - protein, 24 aa, Artificial Sequence
  Description of Artificial Sequence: Synthetic peptide
QDIQMTQSPSSLSASVGDRVTITC

SEQ ID NO: 1191 - protein, 24 aa, Artificial Sequence
  Description of Artificial Sequence: Synthetic peptide
QDIQMTQSPSSLSASVGDRVTITC

SEQ ID NO: 1192 - protein, 24 aa, Artificial Sequence
  Description of Artificial Sequence: Synthetic peptide
QDIQMTQSPSSLSASVGDRVTITC

SEQ ID NO: 1193 - protein, 24 aa, Artificial Sequence
  Description of Artificial Sequence: Synthetic peptide
QDIQMTQSPSSLSASVGDRVTITC

SEQ ID NO: 1194 - protein, 24 aa, Artificial Sequence
  Description of Artificial Sequence: Synthetic peptide
QDIQMTQSPSSLSASVGDRVTITC

SEQ ID NO: 1195 - protein, 11 aa, Artificial Sequence
  Description of Artificial Sequence: Synthetic peptide
RANQSIYTYLN

SEQ ID NO: 1196 - protein, 11 aa, Artificial Sequence
  Description of Artificial Sequence: Synthetic peptide
RANQSIYTYLN

SEQ ID NO: 1197 - protein, 11 aa, Artificial Sequence
  Description of Artificial Sequence: Synthetic peptide
RANQSIYTYLN

SEQ ID NO: 1198 - protein, 11 aa, Artificial Sequence
  Description of Artificial Sequence: Synthetic peptide
RANQSIYTYLN

SEQ ID NO: 1199 - protein, 11 aa, Artificial Sequence
  Description of Artificial Sequence: Synthetic peptide
RANQSIYTYLN

SEQ ID NO: 1200 - protein, 11 aa, Artificial Sequence
  Description of Artificial Sequence: Synthetic peptide
RANQSIYTYLN

SEQ ID NO: 1201 - protein, 11 aa, Artificial Sequence
  Description of Artificial Sequence: Synthetic peptide
RANQSIYTYLN

SEQ ID NO: 1202 - protein, 11 aa, Artificial Sequence
  Description of Artificial Sequence: Synthetic peptide
RANQSIYTYLN

SEQ ID NO: 1203 - protein, 11 aa, Artificial Sequence
  Description of Artificial Sequence: Synthetic peptide
RANQSIYTYLN

SEQ ID NO: 1204 - protein, 11 aa, Artificial Sequence
  Description of Artificial Sequence: Synthetic peptide
RANQSIYTYLN

SEQ ID NO: 1205 - protein, 11 aa, Artificial Sequence
  Description of Artificial Sequence: Synthetic peptide
RANQSIYTYLN

SEQ ID NO: 1206 - protein, 11 aa, Artificial Sequence
  Description of Artificial Sequence: Synthetic peptide
RANQSIYTYLN

SEQ ID NO: 1207 - protein, 11 aa, Artificial Sequence
  Description of Artificial Sequence: Synthetic peptide
RANQSIYTYLN

SEQ ID NO: 1208 - protein, 11 aa, Artificial Sequence
  Description of Artificial Sequence: Synthetic peptide
RANQSIYTYLN

SEQ ID NO: 1209 - protein, 11 aa, Artificial Sequence
  Description of Artificial Sequence: Synthetic peptide
RANQSIYTYLN

SEQ ID NO: 1210 - protein, 11 aa, Artificial Sequence
  Description of Artificial Sequence: Synthetic peptide
RANQSIYTYLN

SEQ ID NO: 1211 - protein, 11 aa, Artificial Sequence
  Description of Artificial Sequence: Synthetic peptide
RANQSIYTYLN

SEQ ID NO: 1212 - protein, 11 aa, Artificial Sequence
  Description of Artificial Sequence: Synthetic peptide
RANQSIYTYLN

SEQ ID NO: 1213 - protein, 11 aa, Artificial Sequence
  Description of Artificial Sequence: Synthetic peptide
RANQSIYTYLN

SEQ ID NO: 1214 - protein, 11 aa, Artificial Sequence
  Description of Artificial Sequence: Synthetic peptide
RANQSIYTYLN

SEQ ID NO: 1215 - protein, 11 aa, Artificial Sequence
  Description of Artificial Sequence: Synthetic peptide
RANQSIYTYLN

SEQ ID NO: 1216 - protein, 11 aa, Artificial Sequence
  Description of Artificial Sequence: Synthetic peptide
RANQSIYTYLN

SEQ ID NO: 1217 - protein, 11 aa, Artificial Sequence
  Description of Artificial Sequence: Synthetic peptide
RANQSIYTYLN

SEQ ID NO: 1218 - protein, 11 aa, Artificial Sequence
  Description of Artificial Sequence: Synthetic peptide
RANQSIYTYLN

SEQ ID NO: 1219 - protein, 11 aa, Artificial Sequence
  Description of Artificial Sequence: Synthetic peptide
RANQSIYTYLN

SEQ ID NO: 1220 - protein, 11 aa, Artificial Sequence
  Description of Artificial Sequence: Synthetic peptide
RANQSIYTYLN

SEQ ID NO: 1221 - protein, 11 aa, Artificial Sequence
  Description of Artificial Sequence: Synthetic peptide
RANQSIYTYLN

SEQ ID NO: 1222 - protein, 11 aa, Artificial Sequence
  Description of Artificial Sequence: Synthetic peptide
RANQSIYTYLN

SEQ ID NO: 1223 - protein, 11 aa, Artificial Sequence
  Description of Artificial Sequence: Synthetic peptide
RANQSIYTYLN

SEQ ID NO: 1224 - protein, 11 aa, Artificial Sequence
  Description of Artificial Sequence: Synthetic peptide
RANQSIYTYLN

SEQ ID NO: 1225 - protein, 11 aa, Artificial Sequence
  Description of Artificial Sequence: Synthetic peptide
RANQSIYTYLN

SEQ ID NO: 1226 - protein, 11 aa, Artificial Sequence
  Description of Artificial Sequence: Synthetic peptide
RANQSIYTYLN

SEQ ID NO: 1227 - protein, 11 aa, Artificial Sequence
  Description of Artificial Sequence: Synthetic peptide
RANQSIYTYLN

SEQ ID NO: 1228 - protein, 11 aa, Artificial Sequence
  Description of Artificial Sequence: Synthetic peptide
RANQSIYTYLN

SEQ ID NO: 1229 - protein, 11 aa, Artificial Sequence
  Description of Artificial Sequence: Synthetic peptide
RANQSIYTYLN

SEQ ID NO: 1230 - protein, 11 aa, Artificial Sequence
  Description of Artificial Sequence: Synthetic peptide
RANQSIYTYLN

SEQ ID NO: 1231 - protein, 11 aa, Artificial Sequence
  Description of Artificial Sequence: Synthetic peptide
RANQSIYTYLN

SEQ ID NO: 1232 - protein, 11 aa, Artificial Sequence
  Description of Artificial Sequence: Synthetic peptide
RANQSIYTYLN

SEQ ID NO: 1233 - protein, 11 aa, Artificial Sequence
  Description of Artificial Sequence: Synthetic peptide
RANQSIYTYLN

SEQ ID NO: 1234 - protein, 11 aa, Artificial Sequence
  Description of Artificial Sequence: Synthetic peptide
RANQSIYTYLN

SEQ ID NO: 1235 - protein, 11 aa, Artificial Sequence
  Description of Artificial Sequence: Synthetic peptide
RANQSIYTYLN

SEQ ID NO: 1236 - protein, 11 aa, Artificial Sequence
  Description of Artificial Sequence: Synthetic peptide
RANQSIYTYLN

SEQ ID NO: 1237 - protein, 11 aa, Artificial Sequence
  Description of Artificial Sequence: Synthetic peptide
RANQSIYTYLN

SEQ ID NO: 1238 - protein, 11 aa, Artificial Sequence
  Description of Artificial Sequence: Synthetic peptide
RANQSIYTYLN

SEQ ID NO: 1239 - protein, 11 aa, Artificial Sequence
  Description of Artificial Sequence: Synthetic peptide
RANQSIYTYLN

SEQ ID NO: 1240 - protein, 15 aa, Artificial Sequence
  Description of Artificial Sequence: Synthetic peptide
WYQQKPGKAPELLIY

SEQ ID NO: 1241 - protein, 15 aa, Artificial Sequence
  Description of Artificial Sequence: Synthetic peptide
WYQQKPGKAPELLIY

SEQ ID NO: 1242 - protein, 15 aa, Artificial Sequence
  Description of Artificial Sequence: Synthetic peptide
WYQQKPGKAPELLIY

SEQ ID NO: 1243 - protein, 15 aa, Artificial Sequence
  Description of Artificial Sequence: Synthetic peptide
WYQQKPGKAPELLIY

SEQ ID NO: 1244 - protein, 15 aa, Artificial Sequence
  Description of Artificial Sequence: Synthetic peptide
WYQQKPGKAPELLIY

SEQ ID NO: 1245 - protein, 15 aa, Artificial Sequence
  Description of Artificial Sequence: Synthetic peptide
WYQQKPGKAPELLIY

SEQ ID NO: 1246 - protein, 15 aa, Artificial Sequence
  Description of Artificial Sequence: Synthetic peptide
WYQQKPGKAPELLIY

SEQ ID NO: 1247 - protein, 15 aa, Artificial Sequence
  Description of Artificial Sequence: Synthetic peptide
WYQQKPGKAPELLIY

SEQ ID NO: 1248 - protein, 15 aa, Artificial Sequence
  Description of Artificial Sequence: Synthetic peptide
WYQQKPGKAPELLIY

SEQ ID NO: 1249 - protein, 15 aa, Artificial Sequence
  Description of Artificial Sequence: Synthetic peptide
WYQQKPGKAPELLIY

SEQ ID NO: 1250 - protein, 15 aa, Artificial Sequence
  Description of Artificial Sequence: Synthetic peptide
WYQQKPGKAPELLIY

SEQ ID NO: 1251 - protein, 15 aa, Artificial Sequence
  Description of Artificial Sequence: Synthetic peptide
WYQQKPGKAPELLIY

SEQ ID NO: 1252 - protein, 15 aa, Artificial Sequence
  Description of Artificial Sequence: Synthetic peptide
WYQQKPGKAPELLIY

SEQ ID NO: 1253 - protein, 15 aa, Artificial Sequence
  Description of Artificial Sequence: Synthetic peptide
WYQQKPGKAPELLIY

SEQ ID NO: 1254 - protein, 15 aa, Artificial Sequence
  Description of Artificial Sequence: Synthetic peptide
WYQQKPGKAPELLIY

SEQ ID NO: 1255 - protein, 15 aa, Artificial Sequence
  Description of Artificial Sequence: Synthetic peptide
WYQQKPGKAPELLIY

SEQ ID NO: 1256 - protein, 15 aa, Artificial Sequence
  Description of Artificial Sequence: Synthetic peptide
WYQQKPGKAPELLIY

SEQ ID NO: 1257 - protein, 15 aa, Artificial Sequence
  Description of Artificial Sequence: Synthetic peptide
WYQQKPGKAPELLIY

SEQ ID NO: 1258 - protein, 15 aa, Artificial Sequence
  Description of Artificial Sequence: Synthetic peptide
WYQQKPGKAPELLIY

SEQ ID NO: 1259 - protein, 15 aa, Artificial Sequence
  Description of Artificial Sequence: Synthetic peptide
WYQQKPGKAPELLIY

SEQ ID NO: 1260 - protein, 15 aa, Artificial Sequence
  Description of Artificial Sequence: Synthetic peptide
WYQQKPGKAPELLIY

SEQ ID NO: 1261 - protein, 15 aa, Artificial Sequence
  Description of Artificial Sequence: Synthetic peptide
WYQQKPGKAPELLIY

SEQ ID NO: 1262 - protein, 15 aa, Artificial Sequence
  Description of Artificial Sequence: Synthetic peptide
WYQQKPGKAPELLIY

SEQ ID NO: 1263 - protein, 15 aa, Artificial Sequence
  Description of Artificial Sequence: Synthetic peptide
WYQQKPGKAPELLIY

SEQ ID NO: 1264 - protein, 15 aa, Artificial Sequence
  Description of Artificial Sequence: Synthetic peptide
WYQQKPGKAPELLIY

SEQ ID NO: 1265 - protein, 15 aa, Artificial Sequence
  Description of Artificial Sequence: Synthetic peptide
WYQQKPGKAPELLIY

SEQ ID NO: 1266 - protein, 15 aa, Artificial Sequence
  Description of Artificial Sequence: Synthetic peptide
WYQQKPGKAPELLIY

SEQ ID NO: 1267 - protein, 15 aa, Artificial Sequence
  Description of Artificial Sequence: Synthetic peptide
WYQQKPGKAPELLIY

SEQ ID NO: 1268 - protein, 15 aa, Artificial Sequence
  Description of Artificial Sequence: Synthetic peptide
WYQQKPGKAPELLIY

SEQ ID NO: 1269 - protein, 15 aa, Artificial Sequence
  Description of Artificial Sequence: Synthetic peptide
WYQQKPGKAPELLIY

SEQ ID NO: 1270 - protein, 15 aa, Artificial Sequence
  Description of Artificial Sequence: Synthetic peptide
WYQQKPGKAPELLIY

SEQ ID NO: 1271 - protein, 15 aa, Artificial Sequence
  Description of Artificial Sequence: Synthetic peptide
WYQQKPGKAPELLIY

SEQ ID NO: 1272 - protein, 15 aa, Artificial Sequence
  Description of Artificial Sequence: Synthetic peptide
WYQQKPGKAPELLIY

SEQ ID NO: 1273 - protein, 15 aa, Artificial Sequence
  Description of Artificial Sequence: Synthetic peptide
WYQQKPGKAPELLIY

SEQ ID NO: 1274 - protein, 15 aa, Artificial Sequence
  Description of Artificial Sequence: Synthetic peptide
WYQQKPGKAPELLIY

SEQ ID NO: 1275 - protein, 15 aa, Artificial Sequence
  Description of Artificial Sequence: Synthetic peptide
WYQQKPGKAPELLIY

SEQ ID NO: 1276 - protein, 15 aa, Artificial Sequence
  Description of Artificial Sequence: Synthetic peptide
WYQQKPGKAPELLIY

SEQ ID NO: 1277 - protein, 15 aa, Artificial Sequence
  Description of Artificial Sequence: Synthetic peptide
WYQQKPGKAPELLIY

SEQ ID NO: 1278 - protein, 15 aa, Artificial Sequence
  Description of Artificial Sequence: Synthetic peptide
WYQQKPGKAPELLIY

SEQ ID NO: 1279 - protein, 15 aa, Artificial Sequence
  Description of Artificial Sequence: Synthetic peptide
WYQQKPGKAPELLIY

SEQ ID NO: 1280 - protein, 15 aa, Artificial Sequence
  Description of Artificial Sequence: Synthetic peptide
WYQQKPGKAPELLIY

SEQ ID NO: 1281 - protein, 15 aa, Artificial Sequence
  Description of Artificial Sequence: Synthetic peptide
WYQQKPGKAPELLIY

SEQ ID NO: 1282 - protein, 15 aa, Artificial Sequence
  Description of Artificial Sequence: Synthetic peptide
WYQQKPGKAPELLIY

SEQ ID NO: 1283 - protein, 15 aa, Artificial Sequence
  Description of Artificial Sequence: Synthetic peptide
WYQQKPGKAPELLIY

SEQ ID NO: 1284 - protein, 15 aa, Artificial Sequence
  Description of Artificial Sequence: Synthetic peptide
WYQQKPGKAPELLIY

SEQ ID NO: 1285 - protein, 7 aa, Artificial Sequence
  Description of Artificial Sequence: Synthetic peptide
AASSLQS

SEQ ID NO: 1286 - protein, 7 aa, Artificial Sequence
  Description of Artificial Sequence: Synthetic peptide
AASSLQS

SEQ ID NO: 1287 - protein, 7 aa, Artificial Sequence
  Description of Artificial Sequence: Synthetic peptide
AASSLQS

SEQ ID NO: 1288 - protein, 7 aa, Artificial Sequence
  Description of Artificial Sequence: Synthetic peptide
AASSLQS

SEQ ID NO: 1289 - protein, 7 aa, Artificial Sequence
  Description of Artificial Sequence: Synthetic peptide
AASSLQS

SEQ ID NO: 1290 - protein, 7 aa, Artificial Sequence
  Description of Artificial Sequence: Synthetic peptide
AASSLQS

SEQ ID NO: 1291 - protein, 7 aa, Artificial Sequence
  Description of Artificial Sequence: Synthetic peptide
AASSLQS

SEQ ID NO: 1292 - protein, 7 aa, Artificial Sequence
  Description of Artificial Sequence: Synthetic peptide
AASSLQS

SEQ ID NO: 1293 - protein, 7 aa, Artificial Sequence
  Description of Artificial Sequence: Synthetic peptide
AASSLQS

SEQ ID NO: 1294 - protein, 7 aa, Artificial Sequence
  Description of Artificial Sequence: Synthetic peptide
AASSLQS

SEQ ID NO: 1295 - protein, 7 aa, Artificial Sequence
  Description of Artificial Sequence: Synthetic peptide
AASSLQS

SEQ ID NO: 1296 - protein, 7 aa, Artificial Sequence
  Description of Artificial Sequence: Synthetic peptide
AASSLQS

SEQ ID NO: 1297 - protein, 7 aa, Artificial Sequence
  Description of Artificial Sequence: Synthetic peptide
AASSLQS

SEQ ID NO: 1298 - protein, 7 aa, Artificial Sequence
  Description of Artificial Sequence: Synthetic peptide
AASSLQS

SEQ ID NO: 1299 - protein, 7 aa, Artificial Sequence
  Description of Artificial Sequence: Synthetic peptide
AASSLQS

SEQ ID NO: 1300 - protein, 7 aa, Artificial Sequence
  Description of Artificial Sequence: Synthetic peptide
AASSLQS

SEQ ID NO: 1301 - protein, 7 aa, Artificial Sequence
  Description of Artificial Sequence: Synthetic peptide
AASSLQS

SEQ ID NO: 1302 - protein, 7 aa, Artificial Sequence
  Description of Artificial Sequence: Synthetic peptide
AASSLQS

SEQ ID NO: 1303 - protein, 7 aa, Artificial Sequence
  Description of Artificial Sequence: Synthetic peptide
AASSLQS

SEQ ID NO: 1304 - protein, 7 aa, Artificial Sequence
  Description of Artificial Sequence: Synthetic peptide
AASSLQS

SEQ ID NO: 1305 - protein, 7 aa, Artificial Sequence
  Description of Artificial Sequence: Synthetic peptide
AASSLQS

SEQ ID NO: 1306 - protein, 7 aa, Artificial Sequence
  Description of Artificial Sequence: Synthetic peptide
AASSLQS

SEQ ID NO: 1307 - protein, 7 aa, Artificial Sequence
  Description of Artificial Sequence: Synthetic peptide
AASSLQS

SEQ ID NO: 1308 - protein, 7 aa, Artificial Sequence
  Description of Artificial Sequence: Synthetic peptide
AASSLQS

SEQ ID NO: 1309 - protein, 7 aa, Artificial Sequence
  Description of Artificial Sequence: Synthetic peptide
AASSLQS

SEQ ID NO: 1310 - protein, 7 aa, Artificial Sequence
  Description of Artificial Sequence: Synthetic peptide
AASSLQS

SEQ ID NO: 1311 - protein, 7 aa, Artificial Sequence
  Description of Artificial Sequence: Synthetic peptide
AASSLQS

SEQ ID NO: 1312 - protein, 7 aa, Artificial Sequence
  Description of Artificial Sequence: Synthetic peptide
AASSLQS

SEQ ID NO: 1313 - protein, 7 aa, Artificial Sequence
  Description of Artificial Sequence: Synthetic peptide
AASSLQS

SEQ ID NO: 1314 - protein, 7 aa, Artificial Sequence
  Description of Artificial Sequence: Synthetic peptide
AASSLQS

SEQ ID NO: 1315 - protein, 7 aa, Artificial Sequence
  Description of Artificial Sequence: Synthetic peptide
AASSLQS

SEQ ID NO: 1316 - protein, 7 aa, Artificial Sequence
  Description of Artificial Sequence: Synthetic peptide
AASSLQS

SEQ ID NO: 1317 - protein, 7 aa, Artificial Sequence
  Description of Artificial Sequence: Synthetic peptide
AASSLQS

SEQ ID NO: 1318 - protein, 7 aa, Artificial Sequence
  Description of Artificial Sequence: Synthetic peptide
AASSLQS

SEQ ID NO: 1319 - protein, 7 aa, Artificial Sequence
  Description of Artificial Sequence: Synthetic peptide
AASSLQS

SEQ ID NO: 1320 - protein, 7 aa, Artificial Sequence
  Description of Artificial Sequence: Synthetic peptide
AASSLQS

SEQ ID NO: 1321 - protein, 7 aa, Artificial Sequence
  Description of Artificial Sequence: Synthetic peptide
AASSLQS

SEQ ID NO: 1322 - protein, 7 aa, Artificial Sequence
  Description of Artificial Sequence: Synthetic peptide
AASSLQS

SEQ ID NO: 1323 - protein, 7 aa, Artificial Sequence
  Description of Artificial Sequence: Synthetic peptide
AASSLQS

SEQ ID NO: 1324 - protein, 7 aa, Artificial Sequence
  Description of Artificial Sequence: Synthetic peptide
AASSLQS

SEQ ID NO: 1325 - protein, 7 aa, Artificial Sequence
  Description of Artificial Sequence: Synthetic peptide
AASSLQS

SEQ ID NO: 1326 - protein, 7 aa, Artificial Sequence
  Description of Artificial Sequence: Synthetic peptide
AASSLQS

SEQ ID NO: 1327 - protein, 7 aa, Artificial Sequence
  Description of Artificial Sequence: Synthetic peptide
AASSLQS

SEQ ID NO: 1328 - protein, 7 aa, Artificial Sequence
  Description of Artificial Sequence: Synthetic peptide
AASSLQS

SEQ ID NO: 1329 - protein, 7 aa, Artificial Sequence
  Description of Artificial Sequence: Synthetic peptide
AASSLQS

SEQ ID NO: 1330 - protein, 32 aa, Artificial Sequence; identical to SEQ ID NO: 186
  Description of Artificial Sequence: Synthetic polypeptide

SEQ ID NO: 1331 - protein, 32 aa, Artificial Sequence; identical to SEQ ID NO: 186
  Description of Artificial Sequence: Synthetic polypeptide

SEQ ID NO: 1332 - protein, 32 aa, Artificial Sequence; identical to SEQ ID NO: 186
  Description of Artificial Sequence: Synthetic polypeptide

SEQ ID NO: 1333 - protein, 32 aa, Artificial Sequence; identical to SEQ ID NO: 186
  Description of Artificial Sequence: Synthetic polypeptide

SEQ ID NO: 1334 - protein, 32 aa, Artificial Sequence; identical to SEQ ID NO: 186
  Description of Artificial Sequence: Synthetic polypeptide

SEQ ID NO: 1335 - protein, 32 aa, Artificial Sequence; identical to SEQ ID NO: 186
  Description of Artificial Sequence: Synthetic polypeptide

SEQ ID NO: 1336 - protein, 32 aa, Artificial Sequence; identical to SEQ ID NO: 186
  Description of Artificial Sequence: Synthetic polypeptide

SEQ ID NO: 1337 - protein, 32 aa, Artificial Sequence; identical to SEQ ID NO: 186
  Description of Artificial Sequence: Synthetic polypeptide

SEQ ID NO: 1338 - protein, 32 aa, Artificial Sequence; identical to SEQ ID NO: 186
  Description of Artificial Sequence: Synthetic polypeptide

SEQ ID NO: 1339 - protein, 32 aa, Artificial Sequence; identical to SEQ ID NO: 186
  Description of Artificial Sequence: Synthetic polypeptide

SEQ ID NO: 1340 - protein, 32 aa, Artificial Sequence; identical to SEQ ID NO: 186
  Description of Artificial Sequence: Synthetic polypeptide

SEQ ID NO: 1341 - protein, 32 aa, Artificial Sequence; identical to SEQ ID NO: 186
  Description of Artificial Sequence: Synthetic polypeptide

SEQ ID NO: 1342 - protein, 32 aa, Artificial Sequence; identical to SEQ ID NO: 186
  Description of Artificial Sequence: Synthetic polypeptide

SEQ ID NO: 1343 - protein, 32 aa, Artificial Sequence; identical to SEQ ID NO: 186
  Description of Artificial Sequence: Synthetic polypeptide

SEQ ID NO: 1344 - protein, 32 aa, Artificial Sequence; identical to SEQ ID NO: 186
  Description of Artificial Sequence: Synthetic polypeptide

SEQ ID NO: 1345 - protein, 32 aa, Artificial Sequence; identical to SEQ ID NO: 186
  Description of Artificial Sequence: Synthetic polypeptide

SEQ ID NO: 1346 - protein, 32 aa, Artificial Sequence; identical to SEQ ID NO: 186
  Description of Artificial Sequence: Synthetic polypeptide

SEQ ID NO: 1347 - protein, 32 aa, Artificial Sequence; identical to SEQ ID NO: 186
  Description of Artificial Sequence: Synthetic polypeptide

SEQ ID NO: 1348 - protein, 32 aa, Artificial Sequence; identical to SEQ ID NO: 186
  Description of Artificial Sequence: Synthetic polypeptide

SEQ ID NO: 1349 - protein, 32 aa, Artificial Sequence; identical to SEQ ID NO: 186
  Description of Artificial Sequence: Synthetic polypeptide

SEQ ID NO: 1350 - protein, 32 aa, Artificial Sequence; identical to SEQ ID NO: 186
  Description of Artificial Sequence: Synthetic polypeptide

SEQ ID NO: 1351 - protein, 32 aa, Artificial Sequence; identical to SEQ ID NO: 186
  Description of Artificial Sequence: Synthetic polypeptide

SEQ ID NO: 1352 - protein, 32 aa, Artificial Sequence; identical to SEQ ID NO: 186
  Description of Artificial Sequence: Synthetic polypeptide

SEQ ID NO: 1353 - protein, 32 aa, Artificial Sequence; identical to SEQ ID NO: 186
  Description of Artificial Sequence: Synthetic polypeptide

SEQ ID NO: 1354 - protein, 32 aa, Artificial Sequence; identical to SEQ ID NO: 186
  Description of Artificial Sequence: Synthetic polypeptide

SEQ ID NO: 1355 - protein, 32 aa, Artificial Sequence; identical to SEQ ID NO: 186
  Description of Artificial Sequence: Synthetic polypeptide

SEQ ID NO: 1356 - protein, 32 aa, Artificial Sequence; identical to SEQ ID NO: 186
  Description of Artificial Sequence: Synthetic polypeptide

SEQ ID NO: 1357 - protein, 32 aa, Artificial Sequence; identical to SEQ ID NO: 186
  Description of Artificial Sequence: Synthetic polypeptide

SEQ ID NO: 1358 - protein, 32 aa, Artificial Sequence; identical to SEQ ID NO: 186
  Description of Artificial Sequence: Synthetic polypeptide

SEQ ID NO: 1359 - protein, 32 aa, Artificial Sequence; identical to SEQ ID NO: 186
  Description of Artificial Sequence: Synthetic polypeptide

SEQ ID NO: 1360 - protein, 32 aa, Artificial Sequence; identical to SEQ ID NO: 186
  Description of Artificial Sequence: Synthetic polypeptide

SEQ ID NO: 1361 - protein, 32 aa, Artificial Sequence; identical to SEQ ID NO: 186
  Description of Artificial Sequence: Synthetic polypeptide

SEQ ID NO: 1362 - protein, 32 aa, Artificial Sequence; identical to SEQ ID NO: 186
  Description of Artificial Sequence: Synthetic polypeptide

SEQ ID NO: 1363 - protein, 32 aa, Artificial Sequence; identical to SEQ ID NO: 186
  Description of Artificial Sequence: Synthetic polypeptide

SEQ ID NO: 1364 - protein, 32 aa, Artificial Sequence; identical to SEQ ID NO: 186
  Description of Artificial Sequence: Synthetic polypeptide

SEQ ID NO: 1365 - protein, 32 aa, Artificial Sequence; identical to SEQ ID NO: 186
  Description of Artificial Sequence: Synthetic polypeptide

SEQ ID NO: 1366 - protein, 32 aa, Artificial Sequence; identical to SEQ ID NO: 186
  Description of Artificial Sequence: Synthetic polypeptide

SEQ ID NO: 1367 - protein, 32 aa, Artificial Sequence; identical to SEQ ID NO: 186
  Description of Artificial Sequence: Synthetic polypeptide

SEQ ID NO: 1368 - protein, 32 aa, Artificial Sequence; identical to SEQ ID NO: 186
  Description of Artificial Sequence: Synthetic polypeptide

SEQ ID NO: 1369 - protein, 32 aa, Artificial Sequence; identical to SEQ ID NO: 186
  Description of Artificial Sequence: Synthetic polypeptide

SEQ ID NO: 1370 - protein, 32 aa, Artificial Sequence; identical to SEQ ID NO: 186
  Description of Artificial Sequence: Synthetic polypeptide

SEQ ID NO: 1371 - protein, 32 aa, Artificial Sequence; identical to SEQ ID NO: 186
  Description of Artificial Sequence: Synthetic polypeptide

SEQ ID NO: 1372 - protein, 32 aa, Artificial Sequence; identical to SEQ ID NO: 186
  Description of Artificial Sequence: Synthetic polypeptide

SEQ ID NO: 1373 - protein, 32 aa, Artificial Sequence; identical to SEQ ID NO: 186
  Description of Artificial Sequence: Synthetic polypeptide

SEQ ID NO: 1374 - protein, 32 aa, Artificial Sequence; identical to SEQ ID NO: 186
  Description of Artificial Sequence: Synthetic polypeptide

SEQ ID NO: 1375 - protein, 5 aa, Artificial Sequence
  Description of Artificial Sequence: Synthetic peptide
QQAGI

SEQ ID NO: 1376 - protein, 5 aa, Artificial Sequence
  Description of Artificial Sequence: Synthetic peptide
QQAGI

SEQ ID NO: 1377 - protein, 5 aa, Artificial Sequence
  Description of Artificial Sequence: Synthetic peptide
QQAGI

SEQ ID NO: 1378 - protein, 5 aa, Artificial Sequence
  Description of Artificial Sequence: Synthetic peptide
QQAGI

SEQ ID NO: 1379 - protein, 5 aa, Artificial Sequence
  Description of Artificial Sequence: Synthetic peptide
QQAGI

SEQ ID NO: 1380 - protein, 5 aa, Artificial Sequence
  Description of Artificial Sequence: Synthetic peptide
QQAGI

SEQ ID NO: 1381 - protein, 5 aa, Artificial Sequence
  Description of Artificial Sequence: Synthetic peptide
QQAGI

SEQ ID NO: 1382 - protein, 5 aa, Artificial Sequence
  Description of Artificial Sequence: Synthetic peptide
QQAGI

SEQ ID NO: 1383 - protein, 5 aa, Artificial Sequence
  Description of Artificial Sequence: Synthetic peptide
QQAGI

SEQ ID NO: 1384 - protein, 5 aa, Artificial Sequence
  Description of Artificial Sequence: Synthetic peptide
QQAGI

SEQ ID NO: 1385 - protein, 5 aa, Artificial Sequence
  Description of Artificial Sequence: Synthetic peptide
QQAGI

SEQ ID NO: 1386 - protein, 5 aa, Artificial Sequence
  Description of Artificial Sequence: Synthetic peptide
QQAGI

SEQ ID NO: 1387 - protein, 5 aa, Artificial Sequence
  Description of Artificial Sequence: Synthetic peptide
QQAGI

SEQ ID NO: 1388 - protein, 5 aa, Artificial Sequence
  Description of Artificial Sequence: Synthetic peptide
QQAGI

SEQ ID NO: 1389 - protein, 5 aa, Artificial Sequence
  Description of Artificial Sequence: Synthetic peptide
QQAGI

SEQ ID NO: 1390 - protein, 5 aa, Artificial Sequence
  Description of Artificial Sequence: Synthetic peptide
QQAGI

SEQ ID NO: 1391 - protein, 5 aa, Artificial Sequence
  Description of Artificial Sequence: Synthetic peptide
QQAGI

SEQ ID NO: 1392 - protein, 5 aa, Artificial Sequence
  Description of Artificial Sequence: Synthetic peptide
QQAGI

SEQ ID NO: 1393 - protein, 5 aa, Artificial Sequence
  Description of Artificial Sequence: Synthetic peptide
QQAGI

SEQ ID NO: 1394 - protein, 5 aa, Artificial Sequence
  Description of Artificial Sequence: Synthetic peptide
QQAGI

SEQ ID NO: 1395 - protein, 5 aa, Artificial Sequence
  Description of Artificial Sequence: Synthetic peptide
QQAGI

SEQ ID NO: 1396 - protein, 5 aa, Artificial Sequence
  Description of Artificial Sequence: Synthetic peptide
QQAGI

SEQ ID NO: 1397 - protein, 5 aa, Artificial Sequence
  Description of Artificial Sequence: Synthetic peptide
QQAGI

SEQ ID NO: 1398 - protein, 5 aa, Artificial Sequence
  Description of Artificial Sequence: Synthetic peptide
QQAGI

SEQ ID NO: 1399 - protein, 5 aa, Artificial Sequence
  Description of Artificial Sequence: Synthetic peptide
QQAGI

SEQ ID NO: 1400 - protein, 5 aa, Artificial Sequence
  Description of Artificial Sequence: Synthetic peptide
QQAGI

SEQ ID NO: 1401 - protein, 5 aa, Artificial Sequence
  Description of Artificial Sequence: Synthetic peptide
QQAGI

SEQ ID NO: 1402 - protein, 5 aa, Artificial Sequence
  Description of Artificial Sequence: Synthetic peptide
QQAGI

SEQ ID NO: 1403 - protein, 5 aa, Artificial Sequence
  Description of Artificial Sequence: Synthetic peptide
QQAGI

SEQ ID NO: 1404 - protein, 5 aa, Artificial Sequence
  Description of Artificial Sequence: Synthetic peptide
QQAGI

SEQ ID NO: 1405 - protein, 5 aa, Artificial Sequence
  Description of Artificial Sequence: Synthetic peptide
QQAGI

SEQ ID NO: 1406 - protein, 5 aa, Artificial Sequence
  Description of Artificial Sequence: Synthetic peptide
QQAGI

SEQ ID NO: 1407 - protein, 5 aa, Artificial Sequence
  Description of Artificial Sequence: Synthetic peptide
QQAGI

SEQ ID NO: 1408 - protein, 5 aa, Artificial Sequence
  Description of Artificial Sequence: Synthetic peptide
QQAGI

SEQ ID NO: 1409 - protein, 5 aa, Artificial Sequence
  Description of Artificial Sequence: Synthetic peptide
QQAGI

SEQ ID NO: 1410 - protein, 5 aa, Artificial Sequence
  Description of Artificial Sequence: Synthetic peptide
QQAGI

SEQ ID NO: 1411 - protein, 5 aa, Artificial Sequence
  Description of Artificial Sequence: Synthetic peptide
QQAGI

SEQ ID NO: 1412 - protein, 5 aa, Artificial Sequence
  Description of Artificial Sequence: Synthetic peptide
QQAGI

SEQ ID NO: 1413 - protein, 5 aa, Artificial Sequence
  Description of Artificial Sequence: Synthetic peptide
QQAGI

SEQ ID NO: 1414 - protein, 5 aa, Artificial Sequence
  Description of Artificial Sequence: Synthetic peptide
QQAGI

SEQ ID NO: 1415 - protein, 5 aa, Artificial Sequence
  Description of Artificial Sequence: Synthetic peptide
QQAGI

SEQ ID NO: 1416 - protein, 5 aa, Artificial Sequence
  Description of Artificial Sequence: Synthetic peptide
QQAGI

SEQ ID NO: 1417 - protein, 5 aa, Artificial Sequence
  Description of Artificial Sequence: Synthetic peptide
QQAGI

SEQ ID NO: 1418 - protein, 5 aa, Artificial Sequence
  Description of Artificial Sequence: Synthetic peptide
QQAGI

SEQ ID NO: 1419 - protein, 5 aa, Artificial Sequence
  Description of Artificial Sequence: Synthetic peptide
QQAGI

SEQ ID NO: 1420 - protein, 10 aa, Artificial Sequence
  Description of Artificial Sequence: Synthetic peptide
FGQGTKLEIK

SEQ ID NO: 1421 - protein, 10 aa, Artificial Sequence
  Description of Artificial Sequence: Synthetic peptide
FGQGTKLEIK

SEQ ID NO: 1422 - protein, 10 aa, Artificial Sequence
  Description of Artificial Sequence: Synthetic peptide
FGQGTKLEIK

SEQ ID NO: 1423 - protein, 10 aa, Artificial Sequence
  Description of Artificial Sequence: Synthetic peptide
FGQGTKLEIK

SEQ ID NO: 1424 - protein, 10 aa, Artificial Sequence
  Description of Artificial Sequence: Synthetic peptide
FGQGTKLEIK

SEQ ID NO: 1425 - protein, 10 aa, Artificial Sequence
  Description of Artificial Sequence: Synthetic peptide
FGQGTKLEIK

SEQ ID NO: 1426 - protein, 10 aa, Artificial Sequence
  Description of Artificial Sequence: Synthetic peptide
FGQGTKLEIK

SEQ ID NO: 1427 - protein, 10 aa, Artificial Sequence
  Description of Artificial Sequence: Synthetic peptide
FGQGTKLEIK

SEQ ID NO: 1428 - protein, 10 aa, Artificial Sequence
  Description of Artificial Sequence: Synthetic peptide
FGQGTKLEIK

SEQ ID NO: 1429 - protein, 10 aa, Artificial Sequence
  Description of Artificial Sequence: Synthetic peptide
FGQGTKLEIK

SEQ ID NO: 1430 - protein, 10 aa, Artificial Sequence
  Description of Artificial Sequence: Synthetic peptide
FGQGTKLEIK

SEQ ID NO: 1431 - protein, 10 aa, Artificial Sequence
  Description of Artificial Sequence: Synthetic peptide
FGQGTKLEIK

SEQ ID NO: 1432 - protein, 10 aa, Artificial Sequence
  Description of Artificial Sequence: Synthetic peptide
FGQGTKLEIK

SEQ ID NO: 1433 - protein, 10 aa, Artificial Sequence
  Description of Artificial Sequence: Synthetic peptide
FGQGTKLEIK

SEQ ID NO: 1434 - protein, 10 aa, Artificial Sequence
  Description of Artificial Sequence: Synthetic peptide
FGQGTKLEIK

SEQ ID NO: 1435 - protein, 10 aa, Artificial Sequence
  Description of Artificial Sequence: Synthetic peptide
FGQGTKLEIK

SEQ ID NO: 1436 - protein, 10 aa, Artificial Sequence
  Description of Artificial Sequence: Synthetic peptide
FGQGTKLEIK

SEQ ID NO: 1437 - protein, 10 aa, Artificial Sequence
  Description of Artificial Sequence: Synthetic peptide
FGQGTKLEIK

SEQ ID NO: 1438 - protein, 10 aa, Artificial Sequence
  Description of Artificial Sequence: Synthetic peptide
FGQGTKLEIK

SEQ ID NO: 1439 - protein, 10 aa, Artificial Sequence
  Description of Artificial Sequence: Synthetic peptide
FGQGTKLEIK

SEQ ID NO: 1440 - protein, 10 aa, Artificial Sequence
  Description of Artificial Sequence: Synthetic peptide
FGQGTKLEIK

SEQ ID NO: 1441 - protein, 10 aa, Artificial Sequence
  Description of Artificial Sequence: Synthetic peptide
FGQGTKLEIK

SEQ ID NO: 1442 - protein, 10 aa, Artificial Sequence
  Description of Artificial Sequence: Synthetic peptide
FGQGTKLEIK

SEQ ID NO: 1443 - protein, 10 aa, Artificial Sequence
  Description of Artificial Sequence: Synthetic peptide
FGQGTKLEIK

SEQ ID NO: 1444 - protein, 10 aa, Artificial Sequence
  Description of Artificial Sequence: Synthetic peptide
FGQGTKLEIK

SEQ ID NO: 1445 - protein, 10 aa, Artificial Sequence
  Description of Artificial Sequence: Synthetic peptide
FGQGTKLEIK

SEQ ID NO: 1446 - protein, 10 aa, Artificial Sequence
  Description of Artificial Sequence: Synthetic peptide
FGQGTKLEIK

SEQ ID NO: 1447 - protein, 10 aa, Artificial Sequence
  Description of Artificial Sequence: Synthetic peptide
FGQGTKLEIK

SEQ ID NO: 1448 - protein, 10 aa, Artificial Sequence
  Description of Artificial Sequence: Synthetic peptide
FGQGTKLEIK

SEQ ID NO: 1449 - protein, 10 aa, Artificial Sequence
  Description of Artificial Sequence: Synthetic peptide
FGQGTKLEIK

SEQ ID NO: 1450 - protein, 10 aa, Artificial Sequence
  Description of Artificial Sequence: Synthetic peptide
FGQGTKLEIK

SEQ ID NO: 1451 - protein, 10 aa, Artificial Sequence
  Description of Artificial Sequence: Synthetic peptide
FGQGTKLEIK

SEQ ID NO: 1452 - protein, 10 aa, Artificial Sequence
  Description of Artificial Sequence: Synthetic peptide
FGQGTKLEIK

SEQ ID NO: 1453 - protein, 10 aa, Artificial Sequence
  Description of Artificial Sequence: Synthetic peptide
FGQGTKLEIK

SEQ ID NO: 1454 - protein, 10 aa, Artificial Sequence
  Description of Artificial Sequence: Synthetic peptide
FGQGTKLEIK

SEQ ID NO: 1455 - protein, 10 aa, Artificial Sequence
  Description of Artificial Sequence: Synthetic peptide
FGQGTKLEIK

SEQ ID NO: 1456 - protein, 10 aa, Artificial Sequence
  Description of Artificial Sequence: Synthetic peptide
FGQGTKLEIK

SEQ ID NO: 1457 - protein, 10 aa, Artificial Sequence
  Description of Artificial Sequence: Synthetic peptide
FGQGTKLEIK

SEQ ID NO: 1458 - protein, 10 aa, Artificial Sequence
  Description of Artificial Sequence: Synthetic peptide
FGQGTKLEIK

SEQ ID NO: 1459 - protein, 10 aa, Artificial Sequence
  Description of Artificial Sequence: Synthetic peptide
FGQGTKLEIK

SEQ ID NO: 1460 - protein, 10 aa, Artificial Sequence
  Description of Artificial Sequence: Synthetic peptide
FGQGTKLEIK

SEQ ID NO: 1461 - protein, 10 aa, Artificial Sequence
  Description of Artificial Sequence: Synthetic peptide
FGQGTKLEIK

SEQ ID NO: 1462 - protein, 10 aa, Artificial Sequence
  Description of Artificial Sequence: Synthetic peptide
FGQGTKLEIK

SEQ ID NO: 1463 - protein, 10 aa, Artificial Sequence
  Description of Artificial Sequence: Synthetic peptide
FGQGTKLEIK

SEQ ID NO: 1464 - protein, 10 aa, Artificial Sequence
  Description of Artificial Sequence: Synthetic peptide
FGQGTKLEIK

SEQ ID NO: 1465 - protein, 7 aa, Artificial Sequence
  Description of Artificial Sequence: Synthetic peptide
RTVAAPS

SEQ ID NO: 1466 - protein, 7 aa, Artificial Sequence
  Description of Artificial Sequence: Synthetic peptide
RTVAAPS

SEQ ID NO: 1467 - protein, 7 aa, Artificial Sequence
  Description of Artificial Sequence: Synthetic peptide
RTVAAPS

SEQ ID NO: 1468 - protein, 7 aa, Artificial Sequence
  Description of Artificial Sequence: Synthetic peptide
RTVAAPS

SEQ ID NO: 1469 - protein, 7 aa, Artificial Sequence
  Description of Artificial Sequence: Synthetic peptide
RTVAAPS

SEQ ID NO: 1470 - protein, 7 aa, Artificial Sequence
  Description of Artificial Sequence: Synthetic peptide
RTVAAPS

SEQ ID NO: 1471 - protein, 7 aa, Artificial Sequence
  Description of Artificial Sequence: Synthetic peptide
RTVAAPS

SEQ ID NO: 1472 - protein, 7 aa, Artificial Sequence
  Description of Artificial Sequence: Synthetic peptide
RTVAAPS

SEQ ID NO: 1473 - protein, 7 aa, Artificial Sequence
  Description of Artificial Sequence: Synthetic peptide
RTVAAPS

SEQ ID NO: 1474 - protein, 7 aa, Artificial Sequence
  Description of Artificial Sequence: Synthetic peptide
RTVAAPS

SEQ ID NO: 1475 - protein, 7 aa, Artificial Sequence
  Description of Artificial Sequence: Synthetic peptide
RTVAAPS

SEQ ID NO: 1476 - protein, 7 aa, Artificial Sequence
  Description of Artificial Sequence: Synthetic peptide
RTVAAPS

SEQ ID NO: 1477 - protein, 7 aa, Artificial Sequence
  Description of Artificial Sequence: Synthetic peptide
RTVAAPS

SEQ ID NO: 1478 - protein, 7 aa, Artificial Sequence
  Description of Artificial Sequence: Synthetic peptide
RTVAAPS

SEQ ID NO: 1479 - protein, 7 aa, Artificial Sequence
  Description of Artificial Sequence: Synthetic peptide
RTVAAPS

SEQ ID NO: 1480 - protein, 7 aa, Artificial Sequence
  Description of Artificial Sequence: Synthetic peptide
RTVAAPS

SEQ ID NO: 1481 - protein, 7 aa, Artificial Sequence
  Description of Artificial Sequence: Synthetic peptide
RTVAAPS

SEQ ID NO: 1482 - protein, 7 aa, Artificial Sequence
  Description of Artificial Sequence: Synthetic peptide
RTVAAPS

SEQ ID NO: 1483 - protein, 7 aa, Artificial Sequence
  Description of Artificial Sequence: Synthetic peptide
RTVAAPS

SEQ ID NO: 1484 - protein, 7 aa, Artificial Sequence
  Description of Artificial Sequence: Synthetic peptide
RTVAAPS

SEQ ID NO: 1485 - protein, 7 aa, Artificial Sequence
  Description of Artificial Sequence: Synthetic peptide
RTVAAPS

SEQ ID NO: 1486 - protein, 7 aa, Artificial Sequence
  Description of Artificial Sequence: Synthetic peptide
RTVAAPS

SEQ ID NO: 1487 - protein, 7 aa, Artificial Sequence
  Description of Artificial Sequence: Synthetic peptide
RTVAAPS

SEQ ID NO: 1488 - protein, 7 aa, Artificial Sequence
  Description of Artificial Sequence: Synthetic peptide
RTVAAPS

SEQ ID NO: 1489 - protein, 7 aa, Artificial Sequence
  Description of Artificial Sequence: Synthetic peptide
RTVAAPS

SEQ ID NO: 1490 - protein, 7 aa, Artificial Sequence
  Description of Artificial Sequence: Synthetic peptide
RTVAAPS

SEQ ID NO: 1491 - protein, 7 aa, Artificial Sequence
  Description of Artificial Sequence: Synthetic peptide
RTVAAPS

SEQ ID NO: 1492 - protein, 7 aa, Artificial Sequence
  Description of Artificial Sequence: Synthetic peptide
RTVAAPS

SEQ ID NO: 1493 - protein, 7 aa, Artificial Sequence
  Description of Artificial Sequence: Synthetic peptide
RTVAAPS

SEQ ID NO: 1494 - protein, 7 aa, Artificial Sequence
  Description of Artificial Sequence: Synthetic peptide
RTVAAPS

SEQ ID NO: 1495 - protein, 7 aa, Artificial Sequence
  Description of Artificial Sequence: Synthetic peptide
RTVAAPS

SEQ ID NO: 1496 - protein, 7 aa, Artificial Sequence
  Description of Artificial Sequence: Synthetic peptide
RTVAAPS

SEQ ID NO: 1497 - protein, 7 aa, Artificial Sequence
  Description of Artificial Sequence: Synthetic peptide
RTVAAPS

SEQ ID NO: 1498 - protein, 7 aa, Artificial Sequence
  Description of Artificial Sequence: Synthetic peptide
RTVAAPS

SEQ ID NO: 1499 - protein, 7 aa, Artificial Sequence
  Description of Artificial Sequence: Synthetic peptide
RTVAAPS

SEQ ID NO: 1500 - protein, 7 aa, Artificial Sequence
  Description of Artificial Sequence: Synthetic peptide
RTVAAPS

SEQ ID NO: 1501 - protein, 7 aa, Artificial Sequence
  Description of Artificial Sequence: Synthetic peptide
RTVAAPS

SEQ ID NO: 1502 - protein, 7 aa, Artificial Sequence
  Description of Artificial Sequence: Synthetic peptide
RTVAAPS

SEQ ID NO: 1503 - protein, 7 aa, Artificial Sequence
  Description of Artificial Sequence: Synthetic peptide
RTVAAPS

SEQ ID NO: 1504 - protein, 7 aa, Artificial Sequence
  Description of Artificial Sequence: Synthetic peptide
RTVAAPS

SEQ ID NO: 1505 - protein, 7 aa, Artificial Sequence
  Description of Artificial Sequence: Synthetic peptide
RTVAAPS

SEQ ID NO: 1506 - protein, 7 aa, Artificial Sequence
  Description of Artificial Sequence: Synthetic peptide
RTVAAPS

SEQ ID NO: 1507 - protein, 7 aa, Artificial Sequence
  Description of Artificial Sequence: Synthetic peptide
RTVAAPS

SEQ ID NO: 1508 - protein, 7 aa, Artificial Sequence
  Description of Artificial Sequence: Synthetic peptide
RTVAAPS

SEQ ID NO: 1509 - protein, 7 aa, Artificial Sequence
  Description of Artificial Sequence: Synthetic peptide
RTVAAPS

SEQ ID NO: 1510 - protein, 30 aa, Artificial Sequence; identical to SEQ ID NO: 322
  Description of Artificial Sequence: Synthetic polypeptide

SEQ ID NO: 1511 - protein, 30 aa, Artificial Sequence; identical to SEQ ID NO: 322
  Description of Artificial Sequence: Synthetic polypeptide

SEQ ID NO: 1512 - protein, 30 aa, Artificial Sequence; identical to SEQ ID NO: 322
  Description of Artificial Sequence: Synthetic polypeptide

SEQ ID NO: 1513 - protein, 30 aa, Artificial Sequence; identical to SEQ ID NO: 322
  Description of Artificial Sequence: Synthetic polypeptide

SEQ ID NO: 1514 - protein, 30 aa, Artificial Sequence; identical to SEQ ID NO: 322
  Description of Artificial Sequence: Synthetic polypeptide

SEQ ID NO: 1515 - protein, 30 aa, Artificial Sequence; identical to SEQ ID NO: 322
  Description of Artificial Sequence: Synthetic polypeptide

SEQ ID NO: 1516 - protein, 30 aa, Artificial Sequence; identical to SEQ ID NO: 322
  Description of Artificial Sequence: Synthetic polypeptide

SEQ ID NO: 1517 - protein, 30 aa, Artificial Sequence; identical to SEQ ID NO: 322
  Description of Artificial Sequence: Synthetic polypeptide

SEQ ID NO: 1518 - protein, 30 aa, Artificial Sequence; identical to SEQ ID NO: 322
  Description of Artificial Sequence: Synthetic polypeptide

SEQ ID NO: 1519 - protein, 30 aa, Artificial Sequence; identical to SEQ ID NO: 322
  Description of Artificial Sequence: Synthetic polypeptide

SEQ ID NO: 1520 - protein, 30 aa, Artificial Sequence; identical to SEQ ID NO: 322
  Description of Artificial Sequence: Synthetic polypeptide

SEQ ID NO: 1521 - protein, 30 aa, Artificial Sequence; identical to SEQ ID NO: 322
  Description of Artificial Sequence: Synthetic polypeptide

SEQ ID NO: 1522 - protein, 30 aa, Artificial Sequence; identical to SEQ ID NO: 322
  Description of Artificial Sequence: Synthetic polypeptide

SEQ ID NO: 1523 - protein, 30 aa, Artificial Sequence; identical to SEQ ID NO: 322
  Description of Artificial Sequence: Synthetic polypeptide

SEQ ID NO: 1524 - protein, 30 aa, Artificial Sequence; identical to SEQ ID NO: 322
  Description of Artificial Sequence: Synthetic polypeptide

SEQ ID NO: 1525 - protein, 30 aa, Artificial Sequence; identical to SEQ ID NO: 322
  Description of Artificial Sequence: Synthetic polypeptide

SEQ ID NO: 1526 - protein, 30 aa, Artificial Sequence; identical to SEQ ID NO: 322
  Description of Artificial Sequence: Synthetic polypeptide

SEQ ID NO: 1527 - protein, 30 aa, Artificial Sequence; identical to SEQ ID NO: 322
  Description of Artificial Sequence: Synthetic polypeptide

SEQ ID NO: 1528 - protein, 30 aa, Artificial Sequence; identical to SEQ ID NO: 322
  Description of Artificial Sequence: Synthetic polypeptide

SEQ ID NO: 1529 - protein, 30 aa, Artificial Sequence; identical to SEQ ID NO: 322
  Description of Artificial Sequence: Synthetic polypeptide

SEQ ID NO: 1530 - protein, 30 aa, Artificial Sequence; identical to SEQ ID NO: 322
  Description of Artificial Sequence: Synthetic polypeptide

SEQ ID NO: 1531 - protein, 30 aa, Artificial Sequence; identical to SEQ ID NO: 322
  Description of Artificial Sequence: Synthetic polypeptide

SEQ ID NO: 1532 - protein, 30 aa, Artificial Sequence; identical to SEQ ID NO: 322
  Description of Artificial Sequence: Synthetic polypeptide

SEQ ID NO: 1533 - protein, 30 aa, Artificial Sequence; identical to SEQ ID NO: 322
  Description of Artificial Sequence: Synthetic polypeptide

SEQ ID NO: 1534 - protein, 30 aa, Artificial Sequence; identical to SEQ ID NO: 322
  Description of Artificial Sequence: Synthetic polypeptide

SEQ ID NO: 1535 - protein, 30 aa, Artificial Sequence; identical to SEQ ID NO: 322
  Description of Artificial Sequence: Synthetic polypeptide

SEQ ID NO: 1536 - protein, 30 aa, Artificial Sequence; identical to SEQ ID NO: 322
  Description of Artificial Sequence: Synthetic polypeptide

SEQ ID NO: 1537 - protein, 30 aa, Artificial Sequence; identical to SEQ ID NO: 322
  Description of Artificial Sequence: Synthetic polypeptide

SEQ ID NO: 1538 - protein, 30 aa, Artificial Sequence; identical to SEQ ID NO: 322
  Description of Artificial Sequence: Synthetic polypeptide

SEQ ID NO: 1539 - protein, 30 aa, Artificial Sequence; identical to SEQ ID NO: 322
  Description of Artificial Sequence: Synthetic polypeptide

SEQ ID NO: 1540 - protein, 30 aa, Artificial Sequence; identical to SEQ ID NO: 322
  Description of Artificial Sequence: Synthetic polypeptide

SEQ ID NO: 1541 - protein, 30 aa, Artificial Sequence; identical to SEQ ID NO: 322
  Description of Artificial Sequence: Synthetic polypeptide

SEQ ID NO: 1542 - protein, 30 aa, Artificial Sequence; identical to SEQ ID NO: 322
  Description of Artificial Sequence: Synthetic polypeptide

SEQ ID NO: 1543 - protein, 30 aa, Artificial Sequence; identical to SEQ ID NO: 322
  Description of Artificial Sequence: Synthetic polypeptide

SEQ ID NO: 1544 - protein, 30 aa, Artificial Sequence; identical to SEQ ID NO: 322
  Description of Artificial Sequence: Synthetic polypeptide

SEQ ID NO: 1545 - protein, 30 aa, Artificial Sequence; identical to SEQ ID NO: 322
  Description of Artificial Sequence: Synthetic polypeptide

SEQ ID NO: 1546 - protein, 30 aa, Artificial Sequence; identical to SEQ ID NO: 322
  Description of Artificial Sequence: Synthetic polypeptide

SEQ ID NO: 1547 - protein, 30 aa, Artificial Sequence; identical to SEQ ID NO: 322
  Description of Artificial Sequence: Synthetic polypeptide

SEQ ID NO: 1548 - protein, 30 aa, Artificial Sequence; identical to SEQ ID NO: 322
  Description of Artificial Sequence: Synthetic polypeptide

SEQ ID NO: 1549 - protein, 30 aa, Artificial Sequence; identical to SEQ ID NO: 322
  Description of Artificial Sequence: Synthetic polypeptide

SEQ ID NO: 1550 - protein, 30 aa, Artificial Sequence; identical to SEQ ID NO: 322
  Description of Artificial Sequence: Synthetic polypeptide

SEQ ID NO: 1551 - protein, 30 aa, Artificial Sequence; identical to SEQ ID NO: 322
  Description of Artificial Sequence: Synthetic polypeptide

SEQ ID NO: 1552 - protein, 30 aa, Artificial Sequence; identical to SEQ ID NO: 322
  Description of Artificial Sequence: Synthetic polypeptide

SEQ ID NO: 1553 - protein, 30 aa, Artificial Sequence; identical to SEQ ID NO: 322
  Description of Artificial Sequence: Synthetic polypeptide

SEQ ID NO: 1554 - protein, 30 aa, Artificial Sequence; identical to SEQ ID NO: 322
  Description of Artificial Sequence: Synthetic polypeptide

SEQ ID NO: 1555 - protein, 5 aa, Artificial Sequence
  Description of Artificial Sequence: Synthetic peptide
PYWMH

SEQ ID NO: 1556 - protein, 5 aa, Artificial Sequence
  Description of Artificial Sequence: Synthetic peptide
WYWMV

SEQ ID NO: 1557 - protein, 5 aa, Artificial Sequence
  Description of Artificial Sequence: Synthetic peptide
EYWMA

SEQ ID NO: 1558 - protein, 5 aa, Artificial Sequence
  Description of Artificial Sequence: Synthetic peptide
PYWMH

SEQ ID NO: 1559 - protein, 5 aa, Artificial Sequence
  Description of Artificial Sequence: Synthetic peptide
PYWMH

SEQ ID NO: 1560 - protein, 5 aa, Artificial Sequence
  Description of Artificial Sequence: Synthetic peptide
WYWMH

SEQ ID NO: 1561 - protein, 5 aa, Artificial Sequence
  Description of Artificial Sequence: Synthetic peptide
PYWMH

SEQ ID NO: 1562 - protein, 5 aa, Artificial Sequence
  Description of Artificial Sequence: Synthetic peptide
WYWMV

SEQ ID NO: 1563 - protein, 5 aa, Artificial Sequence
  Description of Artificial Sequence: Synthetic peptide
WYWMH

SEQ ID NO: 1564 - protein, 5 aa, Artificial Sequence
  Description of Artificial Sequence: Synthetic peptide
PYWMH

SEQ ID NO: 1565 - protein, 5 aa, Artificial Sequence
  Description of Artificial Sequence: Synthetic peptide
HYWMQ

SEQ ID NO: 1566 - protein, 5 aa, Artificial Sequence
  Description of Artificial Sequence: Synthetic peptide
WYWMG

SEQ ID NO: 1567 - protein, 5 aa, Artificial Sequence
  Description of Artificial Sequence: Synthetic peptide
PYWMH

SEQ ID NO: 1568 - protein, 5 aa, Artificial Sequence
  Description of Artificial Sequence: Synthetic peptide
EYWMT

SEQ ID NO: 1569 - protein, 5 aa, Artificial Sequence
  Description of Artificial Sequence: Synthetic peptide
WYWMH

SEQ ID NO: 1570 - protein, 5 aa, Artificial Sequence
  Description of Artificial Sequence: Synthetic peptide
PYNMH

SEQ ID NO: 1571 - protein, 5 aa, Artificial Sequence
  Description of Artificial Sequence: Synthetic peptide
WYWMG

SEQ ID NO: 1572 - protein, 5 aa, Artificial Sequence
  Description of Artificial Sequence: Synthetic peptide
EYWMT

SEQ ID NO: 1573 - protein, 5 aa, Artificial Sequence
  Description of Artificial Sequence: Synthetic peptide
WYWMV

SEQ ID NO: 1574 - protein, 5 aa, Artificial Sequence
  Description of Artificial Sequence: Synthetic peptide
WYNMS

SEQ ID NO: 1575 - protein, 5 aa, Artificial Sequence
  Description of Artificial Sequence: Synthetic peptide
EYWMT

SEQ ID NO: 1576 - protein, 5 aa, Artificial Sequence
  Description of Artificial Sequence: Synthetic peptide
WYWMV

SEQ ID NO: 1577 - protein, 5 aa, Artificial Sequence
  Description of Artificial Sequence: Synthetic peptide
WYWMV

SEQ ID NO: 1578 - protein, 5 aa, Artificial Sequence
  Description of Artificial Sequence: Synthetic peptide
WYWMH

SEQ ID NO: 1579 - protein, 5 aa, Artificial Sequence
  Description of Artificial Sequence: Synthetic peptide
AYWMH

SEQ ID NO: 1580 - protein, 5 aa, Artificial Sequence
  Description of Artificial Sequence: Synthetic peptide
WYWMV

SEQ ID NO: 1581 - protein, 5 aa, Artificial Sequence
  Description of Artificial Sequence: Synthetic peptide
WYWMH

SEQ ID NO: 1582 - protein, 5 aa, Artificial Sequence
  Description of Artificial Sequence: Synthetic peptide
WYWMH

SEQ ID NO: 1583 - protein, 5 aa, Artificial Sequence
  Description of Artificial Sequence: Synthetic peptide
PYWMS

SEQ ID NO: 1584 - protein, 5 aa, Artificial Sequence
  Description of Artificial Sequence: Synthetic peptide
YYGMG

SEQ ID NO: 1585 - protein, 5 aa, Artificial Sequence
  Description of Artificial Sequence: Synthetic peptide
WYWMH

SEQ ID NO: 1586 - protein, 5 aa, Artificial Sequence
  Description of Artificial Sequence: Synthetic peptide
WYWMG

SEQ ID NO: 1587 - protein, 5 aa, Artificial Sequence
  Description of Artificial Sequence: Synthetic peptide
PYWMH

SEQ ID NO: 1588 - protein, 5 aa, Artificial Sequence
  Description of Artificial Sequence: Synthetic peptide
WYWMH

SEQ ID NO: 1589 - protein, 5 aa, Artificial Sequence
  Description of Artificial Sequence: Synthetic peptide
PYWMH

SEQ ID NO: 1590 - protein, 5 aa, Artificial Sequence
  Description of Artificial Sequence: Synthetic peptide
EYWMA

SEQ ID NO: 1591 - protein, 5 aa, Artificial Sequence
  Description of Artificial Sequence: Synthetic peptide
WYWMV

SEQ ID NO: 1592 - protein, 5 aa, Artificial Sequence
  Description of Artificial Sequence: Synthetic peptide
PYWMH

SEQ ID NO: 1593 - protein, 5 aa, Artificial Sequence
  Description of Artificial Sequence: Synthetic peptide
HYWMQ

SEQ ID NO: 1594 - protein, 5 aa, Artificial Sequence
  Description of Artificial Sequence: Synthetic peptide
EYWMT

SEQ ID NO: 1595 - protein, 5 aa, Artificial Sequence
  Description of Artificial Sequence: Synthetic peptide
PYWMS

SEQ ID NO: 1596 - protein, 5 aa, Artificial Sequence
  Description of Artificial Sequence: Synthetic peptide
WYWMH

SEQ ID NO: 1597 - protein, 5 aa, Artificial Sequence
  Description of Artificial Sequence: Synthetic peptide
WYWMV

SEQ ID NO: 1598 - protein, 5 aa, Artificial Sequence
  Description of Artificial Sequence: Synthetic peptide
WYNMS

SEQ ID NO: 1599 - protein, 5 aa, Artificial Sequence
  Description of Artificial Sequence: Synthetic peptide
PYWMH

SEQ ID NO: 1600 - protein, 14 aa, Artificial Sequence
  Description of Artificial Sequence: Synthetic peptide
WVRQAPGKGLEWVS

SEQ ID NO: 1601 - protein, 14 aa, Artificial Sequence
  Description of Artificial Sequence: Synthetic peptide
WVRQAPGKGLEWVS

SEQ ID NO: 1602 - protein, 14 aa, Artificial Sequence
  Description of Artificial Sequence: Synthetic peptide
WVRQAPGKGLEWVS

SEQ ID NO: 1603 - protein, 14 aa, Artificial Sequence
  Description of Artificial Sequence: Synthetic peptide
WVRQAPGKGLEWVS

SEQ ID NO: 1604 - protein, 14 aa, Artificial Sequence
  Description of Artificial Sequence: Synthetic peptide
WVRQAPGKGLEWVS

SEQ ID NO: 1605 - protein, 14 aa, Artificial Sequence
  Description of Artificial Sequence: Synthetic peptide
WVRQAPGKGLEWVS

SEQ ID NO: 1606 - protein, 14 aa, Artificial Sequence
  Description of Artificial Sequence: Synthetic peptide
WVRQAPGKGLEWVS

SEQ ID NO: 1607 - protein, 14 aa, Artificial Sequence
  Description of Artificial Sequence: Synthetic peptide
WVRQAPGKGLEWVS

SEQ ID NO: 1608 - protein, 14 aa, Artificial Sequence
  Description of Artificial Sequence: Synthetic peptide
WVRQAPGKGLEWVS

SEQ ID NO: 1609 - protein, 14 aa, Artificial Sequence
  Description of Artificial Sequence: Synthetic peptide
WVRQAPGKGLEWVS

SEQ ID NO: 1610 - protein, 14 aa, Artificial Sequence
  Description of Artificial Sequence: Synthetic peptide
WVRQAPGKGLEWVS

SEQ ID NO: 1611 - protein, 14 aa, Artificial Sequence
  Description of Artificial Sequence: Synthetic peptide
WVRQAPGKGLEWVS

SEQ ID NO: 1612 - protein, 14 aa, Artificial Sequence
  Description of Artificial Sequence: Synthetic peptide
WVRQAPGKGLEWVS

SEQ ID NO: 1613 - protein, 14 aa, Artificial Sequence
  Description of Artificial Sequence: Synthetic peptide
WVRQAPGKGLEWVS

SEQ ID NO: 1614 - protein, 14 aa, Artificial Sequence
  Description of Artificial Sequence: Synthetic peptide
WVRQAPGKGLEWVS

SEQ ID NO: 1615 - protein, 14 aa, Artificial Sequence
  Description of Artificial Sequence: Synthetic peptide
WVRQAPGKGLEWVS

SEQ ID NO: 1616 - protein, 14 aa, Artificial Sequence
  Description of Artificial Sequence: Synthetic peptide
WVRQAPGKGLEWVS

SEQ ID NO: 1617 - protein, 14 aa, Artificial Sequence
  Description of Artificial Sequence: Synthetic peptide
WVRQAPGKGLEWVS

SEQ ID NO: 1618 - protein, 14 aa, Artificial Sequence
  Description of Artificial Sequence: Synthetic peptide
WVRQAPGKGLEWVS

SEQ ID NO: 1619 - protein, 14 aa, Artificial Sequence
  Description of Artificial Sequence: Synthetic peptide
WVRQAPGKGLEWVS

SEQ ID NO: 1620 - protein, 14 aa, Artificial Sequence
  Description of Artificial Sequence: Synthetic peptide
WVRQAPGKGLEWVS

SEQ ID NO: 1621 - protein, 14 aa, Artificial Sequence
  Description of Artificial Sequence: Synthetic peptide
WVRQAPGKGLEWVS

SEQ ID NO: 1622 - protein, 14 aa, Artificial Sequence
  Description of Artificial Sequence: Synthetic peptide
WVRQAPGKGLEWVS

SEQ ID NO: 1623 - protein, 14 aa, Artificial Sequence
  Description of Artificial Sequence: Synthetic peptide
WVRQAPGKGLEWVS

SEQ ID NO: 1624 - protein, 14 aa, Artificial Sequence
  Description of Artificial Sequence: Synthetic peptide
WVRQAPGKGLEWVS

SEQ ID NO: 1625 - protein, 14 aa, Artificial Sequence
  Description of Artificial Sequence: Synthetic peptide
WVRQAPGKGLEWVS

SEQ ID NO: 1626 - protein, 14 aa, Artificial Sequence
  Description of Artificial Sequence: Synthetic peptide
WVRQAPGKGLEWVS

SEQ ID NO: 1627 - protein, 14 aa, Artificial Sequence
  Description of Artificial Sequence: Synthetic peptide
WVRQAPGKGLEWVS

SEQ ID NO: 1628 - protein, 14 aa, Artificial Sequence
  Description of Artificial Sequence: Synthetic peptide
WVRQAPGKGLEWVS

SEQ ID NO: 1629 - protein, 14 aa, Artificial Sequence
  Description of Artificial Sequence: Synthetic peptide
WVRQAPGKGLEWVS

SEQ ID NO: 1630 - protein, 14 aa, Artificial Sequence
  Description of Artificial Sequence: Synthetic peptide
WVRQAPGKGLEWVS

SEQ ID NO: 1631 - protein, 14 aa, Artificial Sequence
  Description of Artificial Sequence: Synthetic peptide
WVRQAPGKGLEWVS

SEQ ID NO: 1632 - protein, 14 aa, Artificial Sequence
  Description of Artificial Sequence: Synthetic peptide
WVRQAPGKGLEWVS

SEQ ID NO: 1633 - protein, 14 aa, Artificial Sequence
  Description of Artificial Sequence: Synthetic peptide
WVRQAPGKGLEWVS

SEQ ID NO: 1634 - protein, 14 aa, Artificial Sequence
  Description of Artificial Sequence: Synthetic peptide
WVRQAPGKGLEWVS

SEQ ID NO: 1635 - protein, 14 aa, Artificial Sequence
  Description of Artificial Sequence: Synthetic peptide
WVRQAPGKGLEWVS

SEQ ID NO: 1636 - protein, 14 aa, Artificial Sequence
  Description of Artificial Sequence: Synthetic peptide
WVRQAPGKGLEWVS

SEQ ID NO: 1637 - protein, 14 aa, Artificial Sequence
  Description of Artificial Sequence: Synthetic peptide
WVRQAPGKGLEWVS

SEQ ID NO: 1638 - protein, 14 aa, Artificial Sequence
  Description of Artificial Sequence: Synthetic peptide
WVRQAPGKGLEWVS

SEQ ID NO: 1639 - protein, 14 aa, Artificial Sequence
  Description of Artificial Sequence: Synthetic peptide
WVRQAPGKGLEWVS

SEQ ID NO: 1640 - protein, 14 aa, Artificial Sequence
  Description of Artificial Sequence: Synthetic peptide
WVRQAPGKGLEWVS

SEQ ID NO: 1641 - protein, 14 aa, Artificial Sequence
  Description of Artificial Sequence: Synthetic peptide
WVRQAPGKGLEWVS

SEQ ID NO: 1642 - protein, 14 aa, Artificial Sequence
  Description of Artificial Sequence: Synthetic peptide
WVRQAPGKGLEWVS

SEQ ID NO: 1643 - protein, 14 aa, Artificial Sequence
  Description of Artificial Sequence: Synthetic peptide
WVRQAPGKGLEWVS

SEQ ID NO: 1644 - protein, 14 aa, Artificial Sequence
  Description of Artificial Sequence: Synthetic peptide
WVRQAPGKGLEWVS

SEQ ID NO: 1645 - protein, 17 aa, Artificial Sequence
  Description of Artificial Sequence: Synthetic peptide
GISPSGGETIYADSVKG

SEQ ID NO: 1646 - protein, 17 aa, Artificial Sequence
  Description of Artificial Sequence: Synthetic peptide
SIGPSGGDTYYADSVKG

SEQ ID NO: 1647 - protein, 17 aa, Artificial Sequence
  Description of Artificial Sequence: Synthetic peptide
SISPSGGHTFYADSVKG

SEQ ID NO: 1648 - protein, 17 aa, Artificial Sequence
  Description of Artificial Sequence: Synthetic peptide
GIGPSGGPTFYADSIKG

SEQ ID NO: 1649 - protein, 17 aa, Artificial Sequence
  Description of Artificial Sequence: Synthetic peptide
GIGPSGGPTFYADSIKG

SEQ ID NO: 1650 - protein, 17 aa, Artificial Sequence
  Description of Artificial Sequence: Synthetic peptide
GIVSSGGTTIYADSVKG

SEQ ID NO: 1651 - protein, 17 aa, Artificial Sequence
  Description of Artificial Sequence: Synthetic peptide
GISPSGGNTLYADSVKG

SEQ ID NO: 1652 - protein, 17 aa, Artificial Sequence
  Description of Artificial Sequence: Synthetic peptide
SIVPSGGFTIYADSVKG

SEQ ID NO: 1653 - protein, 17 aa, Artificial Sequence
  Description of Artificial Sequence: Synthetic peptide
GISPSGGPTMYADSVKG

SEQ ID NO: 1654 - protein, 17 aa, Artificial Sequence
  Description of Artificial Sequence: Synthetic peptide
GIGPSGGLTFYADSVKG

SEQ ID NO: 1655 - protein, 17 aa, Artificial Sequence
  Description of Artificial Sequence: Synthetic peptide
GIVPSGGLTMYADSVKG

SEQ ID NO: 1656 - protein, 17 aa, Artificial Sequence
  Description of Artificial Sequence: Synthetic peptide
SISPSGGYTFYADSVKG

SEQ ID NO: 1657 - protein, 17 aa, Artificial Sequence
  Description of Artificial Sequence: Synthetic peptide
GIGPSGGLTFYADSVKG

SEQ ID NO: 1658 - protein, 17 aa, Artificial Sequence
  Description of Artificial Sequence: Synthetic peptide
GISPSGGMTFYADSVKG

SEQ ID NO: 1659 - protein, 17 aa, Artificial Sequence
  Description of Artificial Sequence: Synthetic peptide
GIVSSGGTTIYADSVKG

SEQ ID NO: 1660 - protein, 17 aa, Artificial Sequence
  Description of Artificial Sequence: Synthetic peptide
GISPSGGNTMYADSVKG

SEQ ID NO: 1661 - protein, 17 aa, Artificial Sequence
  Description of Artificial Sequence: Synthetic peptide
SISPSGGYTFYADSVKG

SEQ ID NO: 1662 - protein, 17 aa, Artificial Sequence
  Description of Artificial Sequence: Synthetic peptide
GISPSGGMTFYADSVKG

SEQ ID NO: 1663 - protein, 17 aa, Artificial Sequence
  Description of Artificial Sequence: Synthetic peptide
SIVPSGGFTIYADSVKG

SEQ ID NO: 1664 - protein, 17 aa, Artificial Sequence
  Description of Artificial Sequence: Synthetic peptide
RISPSGGDTGYADSVKG

SEQ ID NO: 1665 - protein, 17 aa, Artificial Sequence
  Description of Artificial Sequence: Synthetic peptide
GISPSGGMTFYADSVKG

SEQ ID NO: 1666 - protein, 17 aa, Artificial Sequence
  Description of Artificial Sequence: Synthetic peptide
SIGPSGGDTYYADSVKG

SEQ ID NO: 1667 - protein, 17 aa, Artificial Sequence
  Description of Artificial Sequence: Synthetic peptide
SIVPSGGFTIYADSVKG

SEQ ID NO: 1668 - protein, 17 aa, Artificial Sequence
  Description of Artificial Sequence: Synthetic peptide
GIVSSGGTTIYADSVKG

SEQ ID NO: 1669 - protein, 17 aa, Artificial Sequence
  Description of Artificial Sequence: Synthetic peptide
GISPSGGLTFYADSVKG

SEQ ID NO: 1670 - protein, 17 aa, Artificial Sequence
  Description of Artificial Sequence: Synthetic peptide
SIGPSGGDTYYADSVKG

SEQ ID NO: 1671 - protein, 17 aa, Artificial Sequence
  Description of Artificial Sequence: Synthetic peptide
GIVSSGGTTIYADSVKG

SEQ ID NO: 1672 - protein, 17 aa, Artificial Sequence
  Description of Artificial Sequence: Synthetic peptide
GIVSSGGTTIYADSVKG

SEQ ID NO: 1673 - protein, 17 aa, Artificial Sequence
  Description of Artificial Sequence: Synthetic peptide
GISPSGGITFYADSVKG

SEQ ID NO: 1674 - protein, 17 aa, Artificial Sequence
  Description of Artificial Sequence: Synthetic peptide
VISSSGGFTFYADSVKG

SEQ ID NO: 1675 - protein, 17 aa, Artificial Sequence
  Description of Artificial Sequence: Synthetic peptide
GIVSSGGTTIYADSVKG

SEQ ID NO: 1676 - protein, 17 aa, Artificial Sequence
  Description of Artificial Sequence: Synthetic peptide
SISPSGGYTFYADSVKG

SEQ ID NO: 1677 - protein, 17 aa, Artificial Sequence
  Description of Artificial Sequence: Synthetic peptide
GISPSGGNTLYADSVKG

SEQ ID NO: 1678 - protein, 17 aa, Artificial Sequence
  Description of Artificial Sequence: Synthetic peptide
GIVSSGGTTIYADSVKG

SEQ ID NO: 1679 - protein, 17 aa, Artificial Sequence
  Description of Artificial Sequence: Synthetic peptide
GIGPSGGPTFYADSVKG

SEQ ID NO: 1680 - protein, 17 aa, Artificial Sequence
  Description of Artificial Sequence: Synthetic peptide
SISPSGGHTFYADSVKG

SEQ ID NO: 1681 - protein, 17 aa, Artificial Sequence
  Description of Artificial Sequence: Synthetic peptide
SIGPSGGDTYYADSVKG

SEQ ID NO: 1682 - protein, 17 aa, Artificial Sequence
  Description of Artificial Sequence: Synthetic peptide
GIGPSGGLTFYADSVKG

SEQ ID NO: 1683 - protein, 17 aa, Artificial Sequence
  Description of Artificial Sequence: Synthetic peptide
GIVPSGGLTMYADSVKG

SEQ ID NO: 1684 - protein, 17 aa, Artificial Sequence
  Description of Artificial Sequence: Synthetic peptide
GISPSGGMTFYADSVKG

SEQ ID NO: 1685 - protein, 17 aa, Artificial Sequence
  Description of Artificial Sequence: Synthetic peptide
GISPSGGITFYADSVKG

SEQ ID NO: 1686 - protein, 17 aa, Artificial Sequence
  Description of Artificial Sequence: Synthetic peptide
GIVSSGGTTIYADSVKG

SEQ ID NO: 1687 - protein, 17 aa, Artificial Sequence
  Description of Artificial Sequence: Synthetic peptide
SIGPSGGDTYYADSVKG

SEQ ID NO: 1688 - protein, 17 aa, Artificial Sequence
  Description of Artificial Sequence: Synthetic peptide
RISPSGGDTGYADSVKG

SEQ ID NO: 1689 - protein, 17 aa, Artificial Sequence
  Description of Artificial Sequence: Synthetic peptide
GIGPSGGPTFYADSIKG

SEQ ID NO: 1690 - protein, 32 aa, Artificial Sequence; identical to SEQ ID NO: 952
  Description of Artificial Sequence: Synthetic polypeptide

SEQ ID NO: 1691 - protein, 32 aa, Artificial Sequence; identical to SEQ ID NO: 952
  Description of Artificial Sequence: Synthetic polypeptide

SEQ ID NO: 1692 - protein, 32 aa, Artificial Sequence; identical to SEQ ID NO: 952
  Description of Artificial Sequence: Synthetic polypeptide

SEQ ID NO: 1693 - protein, 32 aa, Artificial Sequence; identical to SEQ ID NO: 952
  Description of Artificial Sequence: Synthetic polypeptide

SEQ ID NO: 1694 - protein, 32 aa, Artificial Sequence; identical to SEQ ID NO: 458
  Description of Artificial Sequence: Synthetic polypeptide

SEQ ID NO: 1695 - protein, 32 aa, Artificial Sequence; identical to SEQ ID NO: 973
  Description of Artificial Sequence: Synthetic polypeptide

SEQ ID NO: 1696 - protein, 32 aa, Artificial Sequence; identical to SEQ ID NO: 458
  Description of Artificial Sequence: Synthetic polypeptide

SEQ ID NO: 1697 - protein, 32 aa, Artificial Sequence; identical to SEQ ID NO: 458
  Description of Artificial Sequence: Synthetic polypeptide

SEQ ID NO: 1698 - protein, 32 aa, Artificial Sequence; identical to SEQ ID NO: 458
  Description of Artificial Sequence: Synthetic polypeptide

SEQ ID NO: 1699 - protein, 32 aa, Artificial Sequence; identical to SEQ ID NO: 952
  Description of Artificial Sequence: Synthetic polypeptide

SEQ ID NO: 1700 - protein, 32 aa, Artificial Sequence; identical to SEQ ID NO: 458
  Description of Artificial Sequence: Synthetic polypeptide

SEQ ID NO: 1701 - protein, 32 aa, Artificial Sequence; identical to SEQ ID NO: 952
  Description of Artificial Sequence: Synthetic polypeptide

SEQ ID NO: 1702 - protein, 32 aa, Artificial Sequence; identical to SEQ ID NO: 458
  Description of Artificial Sequence: Synthetic polypeptide

SEQ ID NO: 1703 - protein, 32 aa, Artificial Sequence; identical to SEQ ID NO: 952
  Description of Artificial Sequence: Synthetic polypeptide

SEQ ID NO: 1704 - protein, 32 aa, Artificial Sequence; identical to SEQ ID NO: 458
  Description of Artificial Sequence: Synthetic polypeptide

SEQ ID NO: 1705 - protein, 32 aa, Artificial Sequence; identical to SEQ ID NO: 973
  Description of Artificial Sequence: Synthetic polypeptide

SEQ ID NO: 1706 - protein, 32 aa, Artificial Sequence; identical to SEQ ID NO: 458
  Description of Artificial Sequence: Synthetic polypeptide

SEQ ID NO: 1707 - protein, 32 aa, Artificial Sequence; identical to SEQ ID NO: 458
  Description of Artificial Sequence: Synthetic polypeptide

SEQ ID NO: 1708 - protein, 32 aa, Artificial Sequence; identical to SEQ ID NO: 952
  Description of Artificial Sequence: Synthetic polypeptide

SEQ ID NO: 1709 - protein, 32 aa, Artificial Sequence; identical to SEQ ID NO: 458
  Description of Artificial Sequence: Synthetic polypeptide

SEQ ID NO: 1710 - protein, 32 aa, Artificial Sequence; identical to SEQ ID NO: 952
  Description of Artificial Sequence: Synthetic polypeptide

SEQ ID NO: 1711 - protein, 32 aa, Artificial Sequence; identical to SEQ ID NO: 952
  Description of Artificial Sequence: Synthetic polypeptide

SEQ ID NO: 1712 - protein, 32 aa, Artificial Sequence; identical to SEQ ID NO: 458
  Description of Artificial Sequence: Synthetic polypeptide

SEQ ID NO: 1713 - protein, 32 aa, Artificial Sequence; identical to SEQ ID NO: 458
  Description of Artificial Sequence: Synthetic polypeptide

SEQ ID NO: 1714 - protein, 32 aa, Artificial Sequence; identical to SEQ ID NO: 952
  Description of Artificial Sequence: Synthetic polypeptide

SEQ ID NO: 1715 - protein, 32 aa, Artificial Sequence; identical to SEQ ID NO: 952
  Description of Artificial Sequence: Synthetic polypeptide

SEQ ID NO: 1716 - protein, 32 aa, Artificial Sequence; identical to SEQ ID NO: 952
  Description of Artificial Sequence: Synthetic polypeptide

SEQ ID NO: 1717 - protein, 32 aa, Artificial Sequence; identical to SEQ ID NO: 952
  Description of Artificial Sequence: Synthetic polypeptide

SEQ ID NO: 1718 - protein, 32 aa, Artificial Sequence; identical to SEQ ID NO: 952
  Description of Artificial Sequence: Synthetic polypeptide

SEQ ID NO: 1719 - protein, 32 aa, Artificial Sequence; identical to SEQ ID NO: 458
  Description of Artificial Sequence: Synthetic polypeptide

SEQ ID NO: 1720 - protein, 32 aa, Artificial Sequence; identical to SEQ ID NO: 458
  Description of Artificial Sequence: Synthetic polypeptide

SEQ ID NO: 1721 - protein, 32 aa, Artificial Sequence; identical to SEQ ID NO: 952
  Description of Artificial Sequence: Synthetic polypeptide

SEQ ID NO: 1722 - protein, 32 aa, Artificial Sequence; identical to SEQ ID NO: 458
  Description of Artificial Sequence: Synthetic polypeptide

SEQ ID NO: 1723 - protein, 32 aa, Artificial Sequence; identical to SEQ ID NO: 952
  Description of Artificial Sequence: Synthetic polypeptide

SEQ ID NO: 1724 - protein, 32 aa, Artificial Sequence; identical to SEQ ID NO: 458
  Description of Artificial Sequence: Synthetic polypeptide

SEQ ID NO: 1725 - protein, 32 aa, Artificial Sequence; identical to SEQ ID NO: 458
  Description of Artificial Sequence: Synthetic polypeptide

SEQ ID NO: 1726 - protein, 32 aa, Artificial Sequence; identical to SEQ ID NO: 458
  Description of Artificial Sequence: Synthetic polypeptide

SEQ ID NO: 1727 - protein, 32 aa, Artificial Sequence; identical to SEQ ID NO: 458
  Description of Artificial Sequence: Synthetic polypeptide

SEQ ID NO: 1728 - protein, 32 aa, Artificial Sequence; identical to SEQ ID NO: 952
  Description of Artificial Sequence: Synthetic polypeptide

SEQ ID NO: 1729 - protein, 32 aa, Artificial Sequence; identical to SEQ ID NO: 458
  Description of Artificial Sequence: Synthetic polypeptide

SEQ ID NO: 1730 - protein, 32 aa, Artificial Sequence; identical to SEQ ID NO: 952
  Description of Artificial Sequence: Synthetic polypeptide

SEQ ID NO: 1731 - protein, 32 aa, Artificial Sequence; identical to SEQ ID NO: 952
  Description of Artificial Sequence: Synthetic polypeptide

SEQ ID NO: 1732 - protein, 32 aa, Artificial Sequence; identical to SEQ ID NO: 952
  Description of Artificial Sequence: Synthetic polypeptide

SEQ ID NO: 1733 - protein, 32 aa, Artificial Sequence; identical to SEQ ID NO: 458
  Description of Artificial Sequence: Synthetic polypeptide

SEQ ID NO: 1734 - protein, 32 aa, Artificial Sequence; identical to SEQ ID NO: 458
  Description of Artificial Sequence: Synthetic polypeptide

SEQ ID NO: 1735 - protein, 13 aa, Artificial Sequence
  Description of Artificial Sequence: Synthetic peptide
DIWGAYASGLFDY

SEQ ID NO: 1736 - protein, 13 aa, Artificial Sequence
  Description of Artificial Sequence: Synthetic peptide
DIRGAYSSGLFYD

SEQ ID NO: 1737 - protein, 13 aa, Artificial Sequence
  Description of Artificial Sequence: Synthetic peptide
DMRGAYASGLFDY

SEQ ID NO: 1738 - protein, 13 aa, Artificial Sequence
  Description of Artificial Sequence: Synthetic peptide
DIWGAYASGLFDY

SEQ ID NO: 1739 - protein, 13 aa, Artificial Sequence
  Description of Artificial Sequence: Synthetic peptide
DIRGPYSSGLFDY

SEQ ID NO: 1740 - protein, 13 aa, Artificial Sequence
  Description of Artificial Sequence: Synthetic peptide
DIRGAYSSGHFDY

SEQ ID NO: 1741 - protein, 13 aa, Artificial Sequence
  Description of Artificial Sequence: Synthetic peptide
DISGAYSSGLFTF

SEQ ID NO: 1742 - protein, 13 aa, Artificial Sequence
  Description of Artificial Sequence: Synthetic peptide
DIRGAYSSGLFDY

SEQ ID NO: 1743 - protein, 13 aa, Artificial Sequence
  Description of Artificial Sequence: Synthetic peptide
DIRGPYSSGLFDY

SEQ ID NO: 1744 - protein, 13 aa, Artificial Sequence
  Description of Artificial Sequence: Synthetic peptide
DIRGAYSSGMFDF

SEQ ID NO: 1745 - protein, 13 aa, Artificial Sequence
  Description of Artificial Sequence: Synthetic peptide
DISGAYSSGLFTF

SEQ ID NO: 1746 - protein, 13 aa, Artificial Sequence
  Description of Artificial Sequence: Synthetic peptide
DMRGAYASGLFDY

SEQ ID NO: 1747 - protein, 13 aa, Artificial Sequence
  Description of Artificial Sequence: Synthetic peptide
DIRGAYSSGLFDF

SEQ ID NO: 1748 - protein, 13 aa, Artificial Sequence
  Description of Artificial Sequence: Synthetic peptide
DMRGAYASGLFDY

SEQ ID NO: 1749 - protein, 13 aa, Artificial Sequence
  Description of Artificial Sequence: Synthetic peptide
DIRGPYSSGLFDY

SEQ ID NO: 1750 - protein, 13 aa, Artificial Sequence
  Description of Artificial Sequence: Synthetic peptide
DIRGAYSSGHFDY

SEQ ID NO: 1751 - protein, 13 aa, Artificial Sequence
  Description of Artificial Sequence: Synthetic peptide
DIRGAYSSGLFDY

SEQ ID NO: 1752 - protein, 13 aa, Artificial Sequence
  Description of Artificial Sequence: Synthetic peptide
DIRGAYSSGLFDY

SEQ ID NO: 1753 - protein, 13 aa, Artificial Sequence
  Description of Artificial Sequence: Synthetic peptide
DLSGEYASGLFGY

SEQ ID NO: 1754 - protein, 13 aa, Artificial Sequence
  Description of Artificial Sequence: Synthetic peptide
DIRGAYSGGLFDY

SEQ ID NO: 1755 - protein, 13 aa, Artificial Sequence
  Description of Artificial Sequence: Synthetic peptide
DIRGAYSSGMFDF

SEQ ID NO: 1756 - protein, 13 aa, Artificial Sequence
  Description of Artificial Sequence: Synthetic peptide
DLSGEYASGLFGY

SEQ ID NO: 1757 - protein, 13 aa, Artificial Sequence
  Description of Artificial Sequence: Synthetic peptide
DISGAYSSGLFTF

SEQ ID NO: 1758 - protein, 13 aa, Artificial Sequence
  Description of Artificial Sequence: Synthetic peptide
DIRGAYSSGLFDH

SEQ ID NO: 1759 - protein, 13 aa, Artificial Sequence
  Description of Artificial Sequence: Synthetic peptide
DIWGAYASGLFDY

SEQ ID NO: 1760 - protein, 13 aa, Artificial Sequence
  Description of Artificial Sequence: Synthetic peptide
DIWGAYSAGHFEY

SEQ ID NO: 1761 - protein, 13 aa, Artificial Sequence
  Description of Artificial Sequence: Synthetic peptide
DIWGAYSAGHFEY

SEQ ID NO: 1762 - protein, 13 aa, Artificial Sequence
  Description of Artificial Sequence: Synthetic peptide
DIRGAYSSGLFYD

SEQ ID NO: 1763 - protein, 13 aa, Artificial Sequence
  Description of Artificial Sequence: Synthetic peptide
DLSGEYASGLFGY

SEQ ID NO: 1764 - protein, 13 aa, Artificial Sequence
  Description of Artificial Sequence: Synthetic peptide
DISGAYSSGLFTF

SEQ ID NO: 1765 - protein, 13 aa, Artificial Sequence
  Description of Artificial Sequence: Synthetic peptide
DIRGAYSSGLFDF

SEQ ID NO: 1766 - protein, 13 aa, Artificial Sequence
  Description of Artificial Sequence: Synthetic peptide
DLSGEYASGLFGY

SEQ ID NO: 1767 - protein, 13 aa, Artificial Sequence
  Description of Artificial Sequence: Synthetic peptide
DIRGAYSSGLFDY

SEQ ID NO: 1768 - protein, 13 aa, Artificial Sequence
  Description of Artificial Sequence: Synthetic peptide
DFSGAYSAGLFAY

SEQ ID NO: 1769 - protein, 13 aa, Artificial Sequence
  Description of Artificial Sequence: Synthetic peptide
DIRGAYSSGLFDY

SEQ ID NO: 1770 - protein, 13 aa, Artificial Sequence
  Description of Artificial Sequence: Synthetic peptide
DIRGPYSSGLFDY

SEQ ID NO: 1771 - protein, 13 aa, Artificial Sequence
  Description of Artificial Sequence: Synthetic peptide
DIRGAYSSGLFDY

SEQ ID NO: 1772 - protein, 13 aa, Artificial Sequence
  Description of Artificial Sequence: Synthetic peptide
DIRGAYSSGLFDH

SEQ ID NO: 1773 - protein, 13 aa, Artificial Sequence
  Description of Artificial Sequence: Synthetic peptide
DIMGAYASGLFHN

SEQ ID NO: 1774 - protein, 13 aa, Artificial Sequence
  Description of Artificial Sequence: Synthetic peptide
DIRGAYSSGLFDF

SEQ ID NO: 1775 - protein, 13 aa, Artificial Sequence
  Description of Artificial Sequence: Synthetic peptide
DIWGAYSAGHFEY

SEQ ID NO: 1776 - protein, 13 aa, Artificial Sequence
  Description of Artificial Sequence: Synthetic peptide
DLSGEYASGLFGY

SEQ ID NO: 1777 - protein, 13 aa, Artificial Sequence
  Description of Artificial Sequence: Synthetic peptide
DMRGAYASGLFDY

SEQ ID NO: 1778 - protein, 13 aa, Artificial Sequence
  Description of Artificial Sequence: Synthetic peptide
DIRGAYSSGLFDH

SEQ ID NO: 1779 - protein, 13 aa, Artificial Sequence
  Description of Artificial Sequence: Synthetic peptide
DIRGAYSGGLFDY

SEQ ID NO: 1780 - protein, 104 aa, Artificial Sequence; identical to SEQ ID NO: 608
  Description of Artificial Sequence: Synthetic polypeptide

SEQ ID NO: 1781 - protein, 104 aa, Artificial Sequence; identical to SEQ ID NO: 608
  Description of Artificial Sequence: Synthetic polypeptide

SEQ ID NO: 1782 - protein, 104 aa, Artificial Sequence; identical to SEQ ID NO: 608
  Description of Artificial Sequence: Synthetic polypeptide

SEQ ID NO: 1783 - protein, 104 aa, Artificial Sequence; identical to SEQ ID NO: 608
  Description of Artificial Sequence: Synthetic polypeptide

SEQ ID NO: 1784 - protein, 104 aa, Artificial Sequence; identical to SEQ ID NO: 608
  Description of Artificial Sequence: Synthetic polypeptide

SEQ ID NO: 1785 - protein, 104 aa, Artificial Sequence; identical to SEQ ID NO: 608
  Description of Artificial Sequence: Synthetic polypeptide

SEQ ID NO: 1786 - protein, 104 aa, Artificial Sequence; identical to SEQ ID NO: 608
  Description of Artificial Sequence: Synthetic polypeptide

SEQ ID NO: 1787 - protein, 104 aa, Artificial Sequence; identical to SEQ ID NO: 608
  Description of Artificial Sequence: Synthetic polypeptide

SEQ ID NO: 1788 - protein, 104 aa, Artificial Sequence; identical to SEQ ID NO: 608
  Description of Artificial Sequence: Synthetic polypeptide

SEQ ID NO: 1789 - protein, 104 aa, Artificial Sequence; identical to SEQ ID NO: 608
  Description of Artificial Sequence: Synthetic polypeptide

SEQ ID NO: 1790 - protein, 104 aa, Artificial Sequence; identical to SEQ ID NO: 608
  Description of Artificial Sequence: Synthetic polypeptide

SEQ ID NO: 1791 - protein, 104 aa, Artificial Sequence; identical to SEQ ID NO: 608
  Description of Artificial Sequence: Synthetic polypeptide

SEQ ID NO: 1792 - protein, 104 aa, Artificial Sequence; identical to SEQ ID NO: 608
  Description of Artificial Sequence: Synthetic polypeptide

SEQ ID NO: 1793 - protein, 104 aa, Artificial Sequence; identical to SEQ ID NO: 608
  Description of Artificial Sequence: Synthetic polypeptide

SEQ ID NO: 1794 - protein, 104 aa, Artificial Sequence; identical to SEQ ID NO: 608
  Description of Artificial Sequence: Synthetic polypeptide

SEQ ID NO: 1795 - protein, 104 aa, Artificial Sequence; identical to SEQ ID NO: 608
  Description of Artificial Sequence: Synthetic polypeptide

SEQ ID NO: 1796 - protein, 104 aa, Artificial Sequence; identical to SEQ ID NO: 608
  Description of Artificial Sequence: Synthetic polypeptide

SEQ ID NO: 1797 - protein, 104 aa, Artificial Sequence; identical to SEQ ID NO: 608
  Description of Artificial Sequence: Synthetic polypeptide

SEQ ID NO: 1798 - protein, 104 aa, Artificial Sequence; identical to SEQ ID NO: 608
  Description of Artificial Sequence: Synthetic polypeptide

SEQ ID NO: 1799 - protein, 104 aa, Artificial Sequence; identical to SEQ ID NO: 608
  Description of Artificial Sequence: Synthetic polypeptide

SEQ ID NO: 1800 - protein, 104 aa, Artificial Sequence; identical to SEQ ID NO: 608
  Description of Artificial Sequence: Synthetic polypeptide

SEQ ID NO: 1801 - protein, 104 aa, Artificial Sequence; identical to SEQ ID NO: 608
  Description of Artificial Sequence: Synthetic polypeptide

SEQ ID NO: 1802 - protein, 104 aa, Artificial Sequence; identical to SEQ ID NO: 608
  Description of Artificial Sequence: Synthetic polypeptide

SEQ ID NO: 1803 - protein, 104 aa, Artificial Sequence; identical to SEQ ID NO: 608
  Description of Artificial Sequence: Synthetic polypeptide

SEQ ID NO: 1804 - protein, 104 aa, Artificial Sequence; identical to SEQ ID NO: 608
  Description of Artificial Sequence: Synthetic polypeptide

SEQ ID NO: 1805 - protein, 104 aa, Artificial Sequence; identical to SEQ ID NO: 608
  Description of Artificial Sequence: Synthetic polypeptide

SEQ ID NO: 1806 - protein, 104 aa, Artificial Sequence; identical to SEQ ID NO: 608
  Description of Artificial Sequence: Synthetic polypeptide

SEQ ID NO: 1807 - protein, 104 aa, Artificial Sequence; identical to SEQ ID NO: 608
  Description of Artificial Sequence: Synthetic polypeptide

SEQ ID NO: 1808 - protein, 104 aa, Artificial Sequence; identical to SEQ ID NO: 608
  Description of Artificial Sequence: Synthetic polypeptide

SEQ ID NO: 1809 - protein, 104 aa, Artificial Sequence; identical to SEQ ID NO: 608
  Description of Artificial Sequence: Synthetic polypeptide

SEQ ID NO: 1810 - protein, 104 aa, Artificial Sequence; identical to SEQ ID NO: 608
  Description of Artificial Sequence: Synthetic polypeptide

SEQ ID NO: 1811 - protein, 104 aa, Artificial Sequence; identical to SEQ ID NO: 608
  Description of Artificial Sequence: Synthetic polypeptide

SEQ ID NO: 1812 - protein, 104 aa, Artificial Sequence; identical to SEQ ID NO: 608
  Description of Artificial Sequence: Synthetic polypeptide

SEQ ID NO: 1813 - protein, 104 aa, Artificial Sequence; identical to SEQ ID NO: 608
  Description of Artificial Sequence: Synthetic polypeptide

SEQ ID NO: 1814 - protein, 104 aa, Artificial Sequence; identical to SEQ ID NO: 608
  Description of Artificial Sequence: Synthetic polypeptide

SEQ ID NO: 1815 - protein, 104 aa, Artificial Sequence; identical to SEQ ID NO: 608
  Description of Artificial Sequence: Synthetic polypeptide

SEQ ID NO: 1816 - protein, 104 aa, Artificial Sequence; identical to SEQ ID NO: 608
  Description of Artificial Sequence: Synthetic polypeptide

SEQ ID NO: 1817 - protein, 104 aa, Artificial Sequence; identical to SEQ ID NO: 608
  Description of Artificial Sequence: Synthetic polypeptide

SEQ ID NO: 1818 - protein, 104 aa, Artificial Sequence; identical to SEQ ID NO: 608
  Description of Artificial Sequence: Synthetic polypeptide

SEQ ID NO: 1819 - protein, 104 aa, Artificial Sequence; identical to SEQ ID NO: 608
  Description of Artificial Sequence: Synthetic polypeptide

SEQ ID NO: 1820 - protein, 104 aa, Artificial Sequence; identical to SEQ ID NO: 608
  Description of Artificial Sequence: Synthetic polypeptide

SEQ ID NO: 1821 - protein, 104 aa, Artificial Sequence; identical to SEQ ID NO: 608
  Description of Artificial Sequence: Synthetic polypeptide

SEQ ID NO: 1822 - protein, 104 aa, Artificial Sequence; identical to SEQ ID NO: 608
  Description of Artificial Sequence: Synthetic polypeptide

SEQ ID NO: 1823 - protein, 104 aa, Artificial Sequence; identical to SEQ ID NO: 608
  Description of Artificial Sequence: Synthetic polypeptide

SEQ ID NO: 1824 - protein, 104 aa, Artificial Sequence; identical to SEQ ID NO: 608
  Description of Artificial Sequence: Synthetic polypeptide

SEQ ID NO: 1825 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGISPSGGETIYADSVKGRFTISRDNSKNTLYLQMNSLRAEDTAVYYCARDIWGAYASGLFDYWGRGTLVTVSS

SEQ ID NO: 1826 - protein, 122 aa, Artificial Sequence
  Description of Artificial Sequence: Synthetic polypeptide
EVQLLESGGGLVQPGGSLRLSCAASGFTFSWYWMVWVRQAPGKGLEWVSSIGPSGGDTYYADSVKGRFTISRDNSKNTLYLQMNSLRAEDTAVYYCARDIRGAYSSGLFYDWGRGTLVTVSS

SEQ ID NO: 1827 - protein, 122 aa, Artificial Sequence
  Description of Artificial Sequence: Synthetic polypeptide
EVQLLESGGGLVQPGGSLRLSCAASGFTFSEYWMAWVRQAPGKGLEWVSSISPSGGHTFYADSVKGRFTISRDNSKNTLYLQMNSLRAEDTAVYYCARDMRGAYASGLFDYWGRGTLVTVSS

SEQ ID NO: 1828 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGIGPSGGPTFYADSIKGRFTISRDNSKNTLYLQMNSLRAEDTAVYYCARDIWGAYASGLFDYWGRGTLVTVSS

SEQ ID NO: 1829 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGIGPSGGPTFYADSIKGRFTISRDNSKNTLYLQMNSLRAEDTAVYYCAKDIRGPYSSGLFDYWGRGTLVTVSS

SEQ ID NO: 1830 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGIVSSGGTTIYADSVKGRFTISRDDSKNTLYLQMNSLGAEATAVYYCARDIRGAYSSGHFDYWGRGTLVTVSS

SEQ ID NO: 1831 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGISPSGGNTLYADSVKGRFTISRDNSKNTLYLQMNSLRAEDTAVYYCAKDISGAYSSGLFTFWGRGTLVTVSS

SEQ ID NO: 1832 - protein, 122 aa, Artificial Sequence; identical to SEQ ID NO: 671
  Description of Artificial Sequence: Synthetic polypeptide

SEQ ID NO: 1833 - protein, 122 aa, Artificial Sequence; identical to SEQ ID NO: 1073
  Description of Artificial Sequence: Synthetic polypeptide

SEQ ID NO: 1834 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGIGPSGGLTFYADSVKGRFTISRDNSKNTLYLQMNSLRAEDTAVYYCARDIRGAYSSGMFDFWGRGTLVTVSS

SEQ ID NO: 1835 - protein, 122 aa, Artificial Sequence
  Description of Artificial Sequence: Synthetic polypeptide
EVQLLESGGGLVQPGGSLRLSCAASGFTFSHYWMQWVRQAPGKGLEWVSGIVPSGGLTMYADSVKGRFTISRDNSKNTLYLQMNSLRAEDTAVYYCAKDISGAYSSGLFTFWGRGTLVTVSS

SEQ ID NO: 1836 - protein, 122 aa, Artificial Sequence
  Description of Artificial Sequence: Synthetic polypeptide
EVQLLESGGGLVQPGGSLRLSCAASGFTFSWYWMGWVRQAPGKGLEWVSSISPSGGYTFYADSVKGRFTISRDNSKNTLYLQMNSLRAEDTAVYYCARDMRGAYASGLFDYWGRGTLVTVSS

SEQ ID NO: 1837 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGIGPSGGLTFYADSVKGRFTISRDNSKNTLYLQMNSLRAEDTAVYYCAKDIRGAYSSGLFDFWGRGTLVTVSS

SEQ ID NO: 1838 - protein, 122 aa, Artificial Sequence
  Description of Artificial Sequence: Synthetic polypeptide
EVQLLESGGGLVQPGGSLRLSCAASGFTFSEYWMTWVRQAPGKGLEWVSGISPSGGMTFYADSVKGRFTISRDNSKNTLYLQMNSLRAEDTAVYYCARDMRGAYASGLFDYWGRGTLVTVSS

SEQ ID NO: 1839 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGIVSSGGTTIYADSVKGRFTISRDNSKNTLYLQMNSLRAEDTAVYYCAKDIRGPYSSGLFDYWGRGTLVTVSS

SEQ ID NO: 1840 - protein, 121 aa, Artificial Sequence
  Description of Artificial Sequence: Synthetic polypeptide
EVQLLESGGGLVQPGGSLRLSCAASGFTFSPYNMHWVRQAPGKGLEWVSGISPSGGNTMYADSVKGRFTISRDDSKNTLYLQMNSLGAEATAVYYCARDIRGAYSSGHFDYWGRGTLVTSL

SEQ ID NO: 1841 - protein, 122 aa, Artificial Sequence; identical to SEQ ID NO: 644
  Description of Artificial Sequence: Synthetic polypeptide

SEQ ID NO: 1842 - protein, 122 aa, Artificial Sequence; identical to SEQ ID NO: 662
  Description of Artificial Sequence: Synthetic polypeptide

SEQ ID NO: 1843 - protein, 122 aa, Artificial Sequence
  Description of Artificial Sequence: Synthetic polypeptide
EVQLLESGGGLVQPGGSLRLSCAASGFTFSWYWMVWVRQAPGKGLEWVSSIVPSGGFTIYADSVKGRFTISRDNSKNTLYLQMNSLRAEDTAVYYCARDLSGEYASGLFGYWGRGTLVTVSS

SEQ ID NO: 1844 - protein, 122 aa, Artificial Sequence
  Description of Artificial Sequence: Synthetic polypeptide
EVQLLESGGGLVQPGGSLRLSCAASGFTFSWYNMSWVRQAPGKGLEWVSRISPSGGDTGYADSVKGRFTISRDNSKNTLYLQMNSLRAEDTAVYYCAKDIRGAYSGGLFDYWGRGTLVTVSS

SEQ ID NO: 1845 - protein, 122 aa, Artificial Sequence
  Description of Artificial Sequence: Synthetic polypeptide
EVQLLESGGGLVQPGGSLRLSCAASGFTFSEYWMTWVRQAPGKGLEWVSGISPSGGMTFYADSVKGRFTISRDNSKNTLYLQMNSLRAEDTAVYYCARDIRGAYSSGMFDFWGRGTLVTVSS

SEQ ID NO: 1846 - protein, 122 aa, Artificial Sequence
  Description of Artificial Sequence: Synthetic polypeptide
EVQLLESGGGLVQPGGSLRLSCAASGFTFSWYWMVWVRQAPGKGLEWVSSIGPSGGDTYYADSVKGRFTISRDNSKNTLYLQMNSLRAEDTAVYYCARDLSGEYASGLFGYWGRGTLVTVSS

SEQ ID NO: 1847 - protein, 122 aa, Artificial Sequence
  Description of Artificial Sequence: Synthetic polypeptide
EVQLLESGGGLVQPGGSLRLSCAASGFTFSWYWMVWVRQAPGKGLEWVSSIVPSGGFTIYADSVKGRFTISRDNSKNTLYLQMNSLRAEDTAVYYCAKDISGAYSSGLFTFWGRGTLVTVSS

SEQ ID NO: 1848 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGIVSSGGTTIYADSVKGRFTISRDNSKNTLYLQMNSLRAEDTAVYYCAKDIRGAYSSGLFDHWGRGTLVTVSS

SEQ ID NO: 1849 - protein, 122 aa, Artificial Sequence
  Description of Artificial Sequence: Synthetic polypeptide
EVQLLESGGGLVQPGGSLRLSCAASGFTFSAYWMHWVRQAPGKGLEWVSGISPSGGLTFYADSVKGRFTISRDNSKNTLYLQMNSLRAEDTAVYYCARDIWGAYASGLFDYWGRGTLVTVSS

SEQ ID NO: 1850 - protein, 122 aa, Artificial Sequence
  Description of Artificial Sequence: Synthetic polypeptide
EVQLLESGGGLVQPGGSLRLSCAASGFTFSWYWMVWVRQAPGKGLEWVSSIGPSGGDTYYADSVKGRFTISRDNSKNTLYLQMNSLRAEDTAVYYCARDIWGAYSAGHFEYWGRGTLVTVSS

SEQ ID NO: 1851 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGIVSSGGTTIYADSVKGRFTISRDNSKNTLYLQMNSLRAEDTAVYYCARDIWGAYSAGHFEYWGRGTLVTVSS

SEQ ID NO: 1852 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGIVSSGGTTIYADSVKGRFTISRDNSKNTLYLQMNSLRAEDTAVYYCARDIRGAYSSGLFYDWGRGTLVTVSS

SEQ ID NO: 1853 - protein, 122 aa, Artificial Sequence
  Description of Artificial Sequence: Synthetic polypeptide
EVQLLESGGGLVQPGGSLRLSCAASGFTFSPYWMSWVRQAPGKGLEWVSGISPSGGITFYADSVKGRFTISRDNSKNTLYLQMNSLRAEDTAVYYCARDLSGEYASGLFGYWGRGTLVTVSS

SEQ ID NO: 1854 - protein, 122 aa, Artificial Sequence
  Description of Artificial Sequence: Synthetic polypeptide
EVQLLESGGGLVQPGGSLRLSCAASGFTFSYYGMGWVRQAPGKGLEWVSVISSSGGFTFYADSVKGRFTISRDNSKNTLYLQMNSLRAEDTAVYYCAKDISGAYSSGLFTFWGRGTLVTVSS

SEQ ID NO: 1855 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGIVSSGGTTIYADSVKGRFTISRDNSKNTLYLQMNSLRAEDTAVYYCAKDIRGAYSSGLFDFWGRGTLVTVSS

SEQ ID NO: 1856 - protein, 122 aa, Artificial Sequence
  Description of Artificial Sequence: Synthetic polypeptide
EVQLLESGGGLVQPGGSLRLSCAASGFTFSWYWMGWVRQAPGKGLEWVSSISPSGGYTFYADSVKGRFTISRDNSKNTLYLQMNSLRAEDTAVYYCARDLSGEYASGLFGYWGRGTLVTVSS

SEQ ID NO: 1857 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGISPSGGNTLYADSVKGRFTISRDNSKNTLYLQMNSLRAEDTAVYYCAKDIRGAYSSGLFDYWGRGTLVTVSS

SEQ ID NO: 1858 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGIVSSGGTTIYADSVKGRFTISRDNSKNTLYLQMNSLRAEDTAVYYCARDFSGAYSAGLFAYWGRGTLVTVSS

SEQ ID NO: 1859 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGIGPSGGPTFYADSVKGRFTISRDNSKNTLYLQMNSLRAEDTAVYYCAKDIRGAYSSGLFDYWGRGTLVTVSS

SEQ ID NO: 1860 - protein, 122 aa, Artificial Sequence
  Description of Artificial Sequence: Synthetic polypeptide
EVQLLESGGGLVQPGGSLRLSCAASGFTFSEYWMAWVRQAPGKGLEWVSSISPSGGHTFYADSVKGRFTISRDNSKNTLYLQMNSLRAEDTAVYYCAKDIRGPYSSGLFDYWGRGTLVTVSS

SEQ ID NO: 1861 - protein, 122 aa, Artificial Sequence; identical to SEQ ID NO: 647
  Description of Artificial Sequence: Synthetic polypeptide

SEQ ID NO: 1862 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGIGPSGGLTFYADSVKGRFTISRDNSKNTLYLQMNSLRAEDTAVYYCAKDIRGAYSSGLFDHWGRGTLVTVSS

SEQ ID NO: 1863 - protein, 122 aa, Artificial Sequence
  Description of Artificial Sequence: Synthetic polypeptide
EVQLLESGGGLVQPGGSLRLSCAASGFTFSHYWMQWVRQAPGKGLEWVSGIVPSGGLTMYADSVKGRFTISRDNSKNTLYLQMNSLRAEDTAVYYCARDIMGAYASGLFHNWGRGTLVTVSS

SEQ ID NO: 1864 - protein, 122 aa, Artificial Sequence
  Description of Artificial Sequence: Synthetic polypeptide
EVQLLESGGGLVQPGGSLRLSCAASGFTFSEYWMTWVRQAPGKGLEWVSGISPSGGMTFYADSVKGRFTISRDNSKNTLYLQMNSLRAEDTAVYYCAKDIRGAYSSGLFDFWGRGTLVTVSS

SEQ ID NO: 1865 - protein, 122 aa, Artificial Sequence
  Description of Artificial Sequence: Synthetic polypeptide
EVQLLESGGGLVQPGGSLRLSCAASGFTFSPYWMSWVRQAPGKGLEWVSGISPSGGITFYADSVKGRFTISRDNSKNTLYLQMNSLRAEDTAVYYCARDIWGAYSAGHFEYWGRGTLVTVSS

SEQ ID NO: 1866 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGIVSSGGTTIYADSVKGRFTISRDNSKNTLYLQMNSLRAEDTAVYYCARDLSGEYASGLFGYWGRGTLVTVSS

SEQ ID NO: 1867 - protein, 122 aa, Artificial Sequence
  Description of Artificial Sequence: Synthetic polypeptide
EVQLLESGGGLVQPGGSLRLSCAASGFTFSWYWMVWVRQAPGKGLEWVSSIGPSGGDTYYADSVKGRFTISRDNSKNTLYLQMNSLRAEDTAVYYCARDMRGAYASGLFDYWGRGTLVTVSS

SEQ ID NO: 1868 - protein, 122 aa, Artificial Sequence
  Description of Artificial Sequence: Synthetic polypeptide
EVQLLESGGGLVQPGGSLRLSCAASGFTFSWYNMSWVRQAPGKGLEWVSRISPSGGDTGYADSVKGRFTISRDNSKNTLYLQMNSLRAEDTAVYYCAKDIRGAYSSGLFDHWGRGTLVTVSS

SEQ ID NO: 1869 - protein, 122 aa, Artificial Sequence
  Description of Artificial Sequence: Synthetic polypeptide
EVQLLESGGGLVQPGGSLRLSCAASGFTFSPYWMHWVRQAPGKGLEWVSGIGPSGGPTFYADSIKGRFTISRDNSKNTLYLQMNSLRAEDTAVYYCAKDIRGAYSGGLFDYWGRGTLVTVSS

SEQ ID NO: 1870 - protein, 108 aa, Artificial Sequence
  Description of Artificial Sequence: Synthetic polypeptide
QDIQMTQSPGTLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 1871 - protein, 108 aa, Artificial Sequence
  Description of Artificial Sequence: Synthetic polypeptide
QDIQMTQSPSSVSASVGDRVTITCRASQSISSWLAWYQQKPGKAPKLLISTASNLQSGVPSRFSGSGSGTDFTLTISSLQPEDFATYYCQQVSNFPITFGQGTRLEIK

SEQ ID NO: 1872 - protein, 108 aa, Artificial Sequence
  Description of Artificial Sequence: Synthetic polypeptide
QDIQMTQSPATLSLSPGERATLSCRASQSVSSYLAWYQQKPGQAPRLLIYDASNRATGIPARFSGSGSGTDFTLTISSLEPEDFAVYYCQHNEGWPWTFGQGTKVEVK

SEQ ID NO: 1873 - protein, 109 aa, Artificial Sequence
  Description of Artificial Sequence: Synthetic polypeptide
QDIQMTQSPSSLSASVGDRVTITCQASQDISNYLNWYQQKPGKAPKLLIYAASKLEDGVPSRFSGSGTGTDFTLTIRSLQPEDFASYFCQQSYSSPGITFGPGTKVEIK

SEQ ID NO: 1874 - protein, 108 aa, Artificial Sequence
  Description of Artificial Sequence: Synthetic polypeptide
QDIQMTQSPSSFSASTGDRVTITCRASQGISSYLAWYQQKPGKAPKLLIYAASTLQSGVPSRFSGSGSGTHYTLTINSLQPEDFATYYCQQANSFPLTFGGGTKVEIK

SEQ ID NO: 1875 - protein, 110 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSAPLAISGLQFEDEADYYCAVWDDSLNGWVFGGGTKLTVL

SEQ ID NO: 1876 - protein, 109 aa, Artificial Sequence
  Description of Artificial Sequence: Synthetic polypeptide
QDIQMTQSPGTLSLSPGERAALSCRASQSVSSNYLAWYQQKPGQAPRLLMYGASNRATGIPDRFSGSGSGTDFTLTISRLEPEDFAVYYCQQYGRSPRTFGQGTKLEIK

SEQ ID NO: 1877 - protein, 109 aa, Artificial Sequence
  Description of Artificial Sequence: Synthetic polypeptide
QDIQMTQSPGILSLSPGDRATLSCRASQSVTSSSLAWYQQRPGQSPRLLIYGASSRATGIPDRFSGSGSGTDFTLIISRLEPEDFASYYCQQYGGSPITFGPGTKVDIK

SEQ ID NO: 1878 - protein, 108 aa, Artificial Sequence
  Description of Artificial Sequence: Synthetic polypeptide
QDIQMTQSPSSVSASVGDRVTITCRASQDVGSWLAWYQQKPGKAPKLLIFAASSLESGIPSRFSGSGSGTDFTLTISSLQPEDFATYYCQQANGFPLTFGGGTKVEIK

SEQ ID NO: 1879 - protein, 110 aa, Artificial Sequence
  Description of Artificial Sequence: Synthetic polypeptide
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPPITFGQGTRLEIK

SEQ ID NO: 1880 - protein, 109 aa, Artificial Sequence
  Description of Artificial Sequence: Synthetic polypeptide
QDIQMTQSPATLSLSPGERATLSCRASQSVDHFLAWYQQKPGQAPRLLIYGATNRATGVPARFNGTGSGTDFTLTISSLEPEDFAVYYCQQRLNWPPWTFGQGTKVEIK

SEQ ID NO: 1881 - protein, 104 aa, Artificial Sequence; identical to SEQ ID NO: 608
  Description of Artificial Sequence: Synthetic polypeptide

SEQ ID NO: 1882 - protein, 110 aa, Artificial Sequence
  Description of Artificial Sequence: Synthetic polypeptide
QYELTQPPSASGTPGQTVTISCSGSTSNIGSNTVAWYQQVPGTAPKLLIHTNNQRPSGVSDRFSGSKSVASASLAINGLQSEDEADYYCAGWDDSLNGAVFGGGTKVTVL

SEQ ID NO: 1883 - protein, 108 aa, Artificial Sequence
  Description of Artificial Sequence: Synthetic polypeptide
QDIQMTQSPSFLSASVGDRVTITCRASQGISSYLAWYQQKPGKAPKLLIYGASTLQSGVPSRFSGSGSGTDFTLTISSLQPEDFATYYCQQSYTTPYTFGQGTKLEIK

SEQ ID NO: 1884 - protein, 109 aa, Artificial Sequence
  Description of Artificial Sequence: Synthetic polypeptide
QDIQMTQSPGTLSLSPGERATLSCRASQSVSGSYLAWYQQKPGQAPRLLIYGASSRATGIPDRFSGSGSGTDFTLTITRLEPEDFAVYYCQQYGSSPRTFGQGTKVEIK

SEQ ID NO: 1885 - protein, 108 aa, Artificial Sequence
  Description of Artificial Sequence: Synthetic polypeptide
QDIQMTQSPSSLSASVGDRVTITCRTGQSFSNFLNWYQQKPGTAPNLLIYLASNLQSGVPSRFSGSRSGTDFTLTISSLQPEDSAIYYCQQSHSLPWTFGQGTKVEIK

SEQ ID NO: 1886 - protein, 109 aa, Artificial Sequence
  Description of Artificial Sequence: Synthetic polypeptide
QDIQMTQSPGTLSLSPGQRATLSCRASQTVNSNYIAWYQQRPGQAPRLLIYAASSRATGIPDRFSGSGSGTDFTLTIRSLEPEDFAVYYCQKYGRSPQTFGQGTKVEIK

SEQ ID NO: 1887 - protein, 111 aa, Artificial Sequence
  Description of Artificial Sequence: Synthetic polypeptide
QSALTQPPSTSGTPGQRVTISCSGSGSNIGSNPVNWYQQLPGAAPKLLIYSNDLRPSGVPDRFSGSKSGTSASLAISGLQSEDEADYYCAAWDYSLNGPWVFGGGTKLTVL

SEQ ID NO: 1888 - protein, 109 aa, Artificial Sequence
  Description of Artificial Sequence: Synthetic polypeptide
QDIQMTQSPATLSLSPGERATLSCRASQSVSSNLAWYQQKPGQAPRLLIYDASNRATGIPARFSGSGSGTDFTLTISSLEPEDFAVYYCQQRSNWPPLTFGGGTKVEIK

SEQ ID NO: 1889 - protein, 108 aa, Artificial Sequence
  Description of Artificial Sequence: Synthetic polypeptide
QDIQMTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 1890 - protein, 109 aa, Artificial Sequence
  Description of Artificial Sequence: Synthetic polypeptide
QDIQMTQSPGTLSLSPGERATLSCRASQSVSSNYLAWYQQKPGQAPRLLIYGASSRATGISDRFSGSGSGTDFTLTISRLEPEDFAVYYCQQYGTSPETFGGGTKVEIK

SEQ ID NO: 1891 - protein, 108 aa, Artificial Sequence
  Description of Artificial Sequence: Synthetic polypeptide
QDIQMTQSPSSLSASVGDRVTITCRASQGISNYLAWYQQKPGKVPKLLIYAASTLQSGVPSRFSGSGSGTDFTLTISSLQPEDVATYYCQKYNSAPFTFGPGTKVDIK

SEQ ID NO: 1892 - protein, 107 aa, Artificial Sequence
  Description of Artificial Sequence: Synthetic polypeptide
QYELTQPPSVSVSPGQTASITCSGDKLGDKYASWYQQKPGQSPVLVVYHDTRRPSGIPERFSGSNSGNTATLTISGTQAMDEADYYCQAWDDITAVVFGGGTKLTVL

SEQ ID NO: 1893 - protein, 110 aa, Artificial Sequence
  Description of Artificial Sequence: Synthetic polypeptide
QSELTQPRSVSGSPGQSVTISCTGTSNDVGEYNYVSWYQQHPGKAPKVMIYDVTRRPSGVPDRFSGSKSGNTASLTISGLQADDEAHYYCCSYAGRYTYVFGSGTNVTVL

SEQ ID NO: 1894 - protein, 109 aa, Artificial Sequence
  Description of Artificial Sequence: Synthetic polypeptide
QDIQMTQSPGTLSLSSGERATLSCRASQSVSSNYLAWYQQKRGQAPRLLIYGASSRATGVPGRFSGSGSGTDFTLTISRLEPEDFAVYYCQQYGSSPRTFGQGTKLEIK

SEQ ID NO: 1895 - protein, 113 aa, Artificial Sequence
  Description of Artificial Sequence: Synthetic polypeptide
QDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 1896 - protein, 108 aa, Artificial Sequence
  Description of Artificial Sequence: Synthetic polypeptide
QDIQMTQSPSSLSASVGDRVTITCRASQSISIYLNWYQQKAGKAPKLLIYAASNLQSGVPSRFSGSGSGTDFTLTISSLQPEDFATYFCQQSYLPPLTFGGGTTVEIK

SEQ ID NO: 1897 - protein, 110 aa, Artificial Sequence
  Description of Artificial Sequence: Synthetic polypeptide
QDIQMTQSPSSLSASVGDRVTIACRASRGITTALGWYQQKSGTPPKLLIYDASYLDSGVPSRFSGSGSGTDFTLTINSVQPEDFATYYCQQFMTYPQGISFGQGTRLEIK

SEQ ID NO: 1898 - protein, 110 aa, Artificial Sequence
  Description of Artificial Sequence: Synthetic polypeptide
QSELTQPASVSGSPGQSITISCTGTSSDIGGYDYVSWYQQYPGKAPKLMIYHVSNRPSGVSTRFSGSKSANTASLTISGLQAEDEADYYCSSYTSSSTYVFGTGTKVTVL

SEQ ID NO: 1899 - protein, 109 aa, Artificial Sequence
  Description of Artificial Sequence: Synthetic polypeptide
QDIQMTQSPSSLSASVGDRVTITCRASQSISTKLNWYQQKPGKAPNLLIYDTSTLQSGVPSRFSGSGSGTDFTLTISSLQLEDFASYYCQQTYGALTWTFGQGTKVEIK

SEQ ID NO: 1900 - protein, 108 aa, Artificial Sequence
  Description of Artificial Sequence: Synthetic polypeptide
QDIQMTQSPGTLSLSPGERATLSCRASQSVSSSYAAWYQLKPGQAPRLLIYGVSRRATGIPDRFSGSGSGTDFTLTISRLEPEDFAVYYCQQFGSSPTFGQGTKVEIK

SEQ ID NO: 1901 - protein, 109 aa, Artificial Sequence
  Description of Artificial Sequence: Synthetic polypeptide
QDIQMTQSPDSLSASVGDRVTITCRASQSISSYLNWYQQKPGKAPKLLIYAASSLQSGVPSRFSGSGSGTDFTLTISSLQPEDFATYYCQQSYSSPGITFGPGTKVEIK

SEQ ID NO: 1902 - protein, 110 aa, Artificial Sequence
  Description of Artificial Sequence: Synthetic polypeptide
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSLALTFGGGTKVEIK

SEQ ID NO: 1903 - protein, 110 aa, Artificial Sequence
  Description of Artificial Sequence: Synthetic polypeptide
QDIQMTQSPSSLSASVGDRVTITCRASQSISGSLNWYQQKPGKAPKLLIYAASILQSGVPSRFSGSGSGTDFTLTISSLQPEDFATYYCQQNYDLFGGLTFGPGTKVDVK

SEQ ID NO: 1904 - protein, 107 aa, Artificial Sequence
  Description of Artificial Sequence: Synthetic polypeptide
QDIQMTQSPSSLSASVGDRVTITCRTSQDFSNNLAWYQQRPGKAPKLLIYAASTLQSGVPSRFSGSGSGTDFTLTISSLQPEDVATYYCQRYDNGPLFGPGTKVHVK

SEQ ID NO: 1905 - protein, 104 aa, Artificial Sequence
  Description of Artificial Sequence: Synthetic polypeptide
QDIQMTQSPGTLSVSPGERATLSCRASQSVSSNLAWYQQKPGQAPRLLIYGASTRATGIPARFSGSGSGTEFTLTISSLQSEDFAVYYCQLYKTFGGGTKVEIK

SEQ ID NO: 1906 - protein, 109 aa, Artificial Sequence
  Description of Artificial Sequence: Synthetic polypeptide
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKLEIK

SEQ ID NO: 1907 - protein, 108 aa, Artificial Sequence
  Description of Artificial Sequence: Synthetic polypeptide
QDIQMTQSPSSLSASVGDRVTITCRASQSISSYLNWYQQKPGKAPKLLIYAASSLQIGVPSRFSGSGSGTDFTLTISSLQPEDFATYYCQQSYITPLTFGPGTKVDIK

SEQ ID NO: 1908 - protein, 108 aa, Artificial Sequence
  Description of Artificial Sequence: Synthetic polypeptide
QDIQMTQSPSSLSASVGDRVTITCRANQGISNYLAWFQQKPGKAPKSLIYAASSLQSGVPSKFSGSGSGTDFTLTISSLQPEDSATYYCQQYNSFPLTFGGGTKVEIK

SEQ ID NO: 1909 - protein, 108 aa, Artificial Sequence
  Description of Artificial Sequence: Synthetic polypeptide
QDIQMTQSPATLSLSPGERATLSCRASQSVSSYLAWYQQKPGQAPRLLIYDASYRATGIPARFGGSGSGTDFTLTISSLEPEDFALYYCQQRSDWPRTFGQGTKLEIK

SEQ ID NO: 1910 - protein, 112 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLDVVFGGGTKLTVL

SEQ ID NO: 1911 - protein, 111 aa, Artificial Sequence
  Description of Artificial Sequence: Synthetic polypeptide
QSELTQPPSVSGSPRQSVTISCTGTTSDIGGYNHVSWYQHHPGKAPQLLIYDVTRRPSGVPDRFSASKSGNTASLTISGLQAEDEAVYYCSSYGGSYSFHVFGTGTQVTVL

SEQ ID NO: 1912 - protein, 110 aa, Artificial Sequence
  Description of Artificial Sequence: Synthetic polypeptide
QDIQMTQSPGTLSLSPGETATLSCWASQSVAWYQQKPGQPPRLLIYDVSTRATGIPDRFSGSGSGTGSTLTISRLEPEDFAVYFCQQYGYSPLSFDGGTKVEIKRTVAAP

SEQ ID NO: 1913 - protein, 107 aa, Artificial Sequence
  Description of Artificial Sequence: Synthetic polypeptide
QSELTQDPAVSVALGQTVRITCRGDRLRTYYSSWYQQKPRQAPVLVMFGRNNRPSGIPDRFSGSTSGGTASLTITATQADDEADYFCSSRDGSGNFLFGGGTKLTVL

SEQ ID NO: 1914 - protein, 108 aa, Artificial Sequence
  Description of Artificial Sequence: Synthetic polypeptide
QDIQMTQSPLSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 1915 - protein, 111 aa, Artificial Sequence
  Description of Artificial Sequence: Synthetic polypeptide
QSELTQPASVSGSPGQSVTISCSGISYDLYDYIYVSWYQQHPDKAPQLLLYDVDKRPSGISDRFSGSKSGDTASLTISGLRTDDEAEYYCSSFTRTTTVYVFGTGTKVTVL

SEQ ID NO: 1916 - protein, 109 aa, Artificial Sequence
  Description of Artificial Sequence: Synthetic polypeptide
QDIQMTQSPSSLSASVGDRVTITCRASQSISSYLNWYQQKPGKAPKLLIYAASKLEDGVPSRFSGSGTGTDFTLTIRSLQPEDFASYFCQQSYSSPGITFGPGTKVEIK

SEQ ID NO: 1917 - protein, 109 aa, Artificial Sequence
  Description of Artificial Sequence: Synthetic polypeptide
QDIQMTQSPGTLSLSPGERATLSCRASQSVSSSYLAWYQQKPGQAPRLLIYGASSRATGIPDRFSGSGSGTDFTLTISRLEPEDIAVYYCQQYGSSAWTFGQGTKVEIK

SEQ ID NO: 1918 - protein, 110 aa, Artificial Sequence
  Description of Artificial Sequence: Synthetic polypeptide
QDIQMIQSPSSLSASVGDSVTITCRASQNINIYLNWYQQKPGKAPKLLISAASSLQSGVPSRFSGSGSGTDFTLTITDLQPEDLATYYCQQTYSAPPPWTFGPGTKVDIK

SEQ ID NO: 1919 - protein, 108 aa, Artificial Sequence
  Description of Artificial Sequence: Synthetic polypeptide
QDIQMTQSPATLSLSPGERATLSCRASQSVSRYLAWYQQKPGQAPRLLIYGASSRVHGIPDRFSGSGSGTDFTLTISRLEPEDFAVYYCQQYGGSPTTFGGGTKVEIK

SEQ ID NO: 1920 - protein, 113 aa, Artificial Sequence
  Description of Artificial Sequence: Synthetic polypeptide
QDIQMTQSPLSLPVTLGQPASISCRSSQSLVYINGNTYLNWFQQRPGQSPRRLIYNVSNRDSGVPERFSGSGSGTDFTLKISRVEAEDVGVYYCMQGTHWPPAFGQGTKVEIK

SEQ ID NO: 1921 - protein, 111 aa, Artificial Sequence
  Description of Artificial Sequence: Synthetic polypeptide
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPPMYTFGQGTKLEIK

SEQ ID NO: 1922 - protein, 109 aa, Artificial Sequence
  Description of Artificial Sequence: Synthetic polypeptide
QDIQMTQSPSSLSASVGDRVAITCRASQSIDTYLNWYQQKPGKAPKLLIYAASKLEDGVPSRFSGSGTGTDFTLTIRSLQPEDFASYFCQQSYSSPGITFGPGTKVEIK

SEQ ID NO: 1923 - protein, 110 aa, Artificial Sequence
  Description of Artificial Sequence: Synthetic polypeptide
QSALTQPASVSGSPGQSITISCTGTSTDVGGYKYVSWYQQHPGKAPKLVIYEVSNRPSGVSNRFSGSKSGNTASLTISGLQAEDEADYYCSSYTSSTTVVFGGGTKLTVL

SEQ ID NO: 1924 - protein, 110 aa, Artificial Sequence
  Description of Artificial Sequence: Synthetic polypeptide
QSELTQPPSASGTPGQRVTISCSGSSSNIGTNTVNWYQQLPGMAPKVVMSANNERPSGVPDRFSGSKTGTSASLAISGLQSEDEADYYCAAWDENLSGPVFGTGTKVTVL

SEQ ID NO: 1925 - protein, 108 aa, Artificial Sequence
  Description of Artificial Sequence: Synthetic polypeptide
QDIQMTQSPATLSLSPGERATLSCRASQNVYSRLAWYQQKPGQAPRLLIYGASTRATGIPDRFSGSGSGTDFTLTISRLEPEDFALYYCQQYGSSPRTFGQGTKLEIR

SEQ ID NO: 1926 - protein, 110 aa, Artificial Sequence
  Description of Artificial Sequence: Synthetic polypeptide
QDIQMTQSPGTLSLSPGERATLSCRASQTISSNQLAWYQQQKPGQAPRLLVYGAFSTATGIPDRFIGGGSGTDFTLTISRLEPEDFAVYYCQQYGSSPLTFGGGTKVEIK

SEQ ID NO: 1927 - protein, 108 aa, Artificial Sequence
  Description of Artificial Sequence: Synthetic polypeptide
QDIQMTQSPGTLSLSPGESATLSCRASHSVDRLYLAWYQQKPGQAPRLLIYGTSSRATGIPDRVSGSGSGTDFTLTISRLEREDSAVYYCQHYGSLWTFGQGTKVEIK

SEQ ID NO: 1928 - protein, 108 aa, Artificial Sequence
  Description of Artificial Sequence: Synthetic polypeptide
QDIQMTQSPSSLSASVGDRVTITCRASQRIASYLNWYQQKPGKAPKLLIYAASSLQSGVPSRFSGSGSGTDFTLTVSSLQPEDFATYYCQQSYSAPLTFGGGTKVEIK

SEQ ID NO: 1929 - protein, 104 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQSGLTFGGGTKVEIK

SEQ ID NO: 1930 - protein, 108 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 1931 - protein, 110 aa, Artificial Sequence
  Description of Artificial Sequence: Synthetic polypeptide
QSVLTQPASVSGSPGQSITISCTGTSTDVGGYNYVSWYQKHPGKAPKLMIYDVSNRPSGVSNRFSGSKSGNTASLTISGLQAEDEADYYCSSYTNTITVVFGGGTKLTVL

SEQ ID NO: 1932 - protein, 108 aa, Artificial Sequence
  Description of Artificial Sequence: Synthetic polypeptide
QDIQMTQSPSSLSASVGDRVTITCRASQGIRNDLGWYQQKPGKAPKLLIYAASSLQSGVPSRFSGSGFGTDFTLTISSLQPEDFATYYCLQDYRYPLTFGGGTKVEIK

SEQ ID NO: 1933 - protein, 109 aa, Artificial Sequence; identical to SEQ ID NO: 1922
  Description of Artificial Sequence: Synthetic polypeptide

SEQ ID NO: 1934 - protein, 107 aa, Artificial Sequence
  Description of Artificial Sequence: Synthetic polypeptide
QDIQMTQSPSSLSASVGDRVTITCRASQSISSYLNWYQQKPGKAPKLLIYAASKLEDGVPSRFSGSGTGTDFTLTINSLQPEDFATYYCQQSYNTPSFGPGTRVDVK

SEQ ID NO: 1935 - protein, 108 aa, Artificial Sequence
  Description of Artificial Sequence: Synthetic polypeptide
QDIQMTQSPATLSASVGDRVTITCRASQRISSYLNWYQQKPGKAPKLLIYAASSLQSGVPSRFSGSGSGTDFTLTISSLQPEDFATYYCQQSYSTPRTFGQGTKVEIK

SEQ ID NO: 1936 - protein, 108 aa, Artificial Sequence
  Description of Artificial Sequence: Synthetic polypeptide
QDIQMTQSPSSLSASVGDRVTITCRASQDISSWLVWYQQKPGKAPKVLIYAASSLQSGIPSRFSGSGSGTDFTLTISSLQPEDFATYYCQQANRFPLTFGGGTKVEIK

SEQ ID NO: 1937 - protein, 108 aa, Artificial Sequence
  Description of Artificial Sequence: Synthetic polypeptide
QDIQMTQSPATLSVSPGERATLSCRASQSVSSSLAWYQQKPGQAPRLLISETSNRATAIPAKFSGSGFGTDFTLTISSLEPEDSAVYYCQQHVSWPLTFGGGTKVEIK

SEQ ID NO: 1938 - protein, 111 aa, Artificial Sequence
  Description of Artificial Sequence: Synthetic polypeptide
QSALTQPPSVSGAPGQTVTISCTGTSSNIGTGYAVHWYQHLPGKAPKPLFSGDDNRPSGVPDRFSASKSGTSASLAIARLQTEDEADYYCESYDYKLGGWVFGGGTKLTVL

SEQ ID NO: 1939 - protein, 120 aa, Artificial Sequence
  Description of Artificial Sequence: Synthetic polypeptide
EVQLLESGGGLVQPGGSLRLSCAASGFTFSYYKMHWVRQAPGKGLEWVSWIGPSGGITDYADSVKGRFTISRDNSKNTLYLQMNSLRAEDTAVYYCTTDDISDYYGMDVWGQGTTVTVSS

SEQ ID NO: 1940 - protein, 121 aa, Artificial Sequence
  Description of Artificial Sequence: Synthetic polypeptide
EVQLLESGGGLVQPGGSLRLSCAASGFTFSWYPMNWVRQAPGKGLEWVSVIWPSGGETAYADSVKGRFTISRDNSKNTLYLQMNSLRAEDTAVYYCTTGRFYGYYRDFDYWGQGTLVTVSS

SEQ ID NO: 1941 - protein, 129 aa, Artificial Sequence
  Description of Artificial Sequence: Synthetic polypeptide
EVQLLESGGGLVQPGGSLRLSCAASGFTFSWYDMLWVRQAPGKGLEWVSYISPSGGYTLYADSVKGRFTISRDNSKNTLYLQMNSLRAEDTAVYYCTTVPTPYTYCSGGSCYRDAFDIWGQGTMVTVSS

SEQ ID NO: 1942 - protein, 126 aa, Artificial Sequence
  Description of Artificial Sequence: Synthetic polypeptide
EVQLLESGGGLVQPGGSLRLSCAASGFTFSYYPMYWVRQAPGKGLEWVSVIGSSGGNTSYADSVKGRFTISRDNSKNTLYLQMNSLRAEDTAVYYCAGAHYDFWSDYYGPDAFDIWGQGTMVTVSS

SEQ ID NO: 1943 - protein, 118 aa, Artificial Sequence
  Description of Artificial Sequence: Synthetic polypeptide
EVQLLESGGGLVQPGGSLRLSCAASGFTFSWYLMGWVRQAPGKGLEWVSSIYPSGGITNYADSVKGRFTISRDNSKNTLYLQMNSLRAEDTAVYYCARGGGADAFDIWGQGTMVTVSS

SEQ ID NO: 1944 - protein, 133 aa, Artificial Sequence
  Description of Artificial Sequence: Synthetic polypeptide
EVQLLESGGGLVQPGGSLRLSCAASGFTFSRYHMTWVRQAPGKGLEWVSSISPSGGPTYYADSVKGRFTISRDNSKNTLYLQMNSLRAEDTAVYYCAKGVRSYYDFWSGYSLYYYYYYGMDVWGQGTTVTVSS

SEQ ID NO: 1945 - protein, 126 aa, Artificial Sequence
  Description of Artificial Sequence: Synthetic polypeptide
EVQLLESGGGLVQPGGSLRLSCAASGFTFSGYNMVWVRQAPGKGLEWVSIVSSGGLTDYADSVKGRFTISRDNSKNTLYLQMNSLRAEDTAVYYCAKGLYYYDSSGYYYGGAFDIWGQGTMVTVSS

SEQ ID NO: 1946 - protein, 126 aa, Artificial Sequence
  Description of Artificial Sequence: Synthetic polypeptide
EVQLLESGGGLVQPGGSLRLSCAASGFTFSTYQMWWVRQAPGKGLEWVSGISSSGGATGYADSVKGRFTISRDNSKNTLYLQMNSLRAEDTAVYYCTRVPHYYDSSGYYGGLVDYWGQGTLVTVSS

SEQ ID NO: 1947 - protein, 124 aa, Artificial Sequence
  Description of Artificial Sequence: Synthetic polypeptide
EVQLLESGGGLVQPGGSLRLSCAASGFTFSRYLMHWVRQAPGKGLEWVSSISSSGGETDYADSVKGRFTISRDNSKNTLYLQMNSLRAEDTAVYYCAHGAPLGDYYYYYGMDVWGQGTTVTVSS

SEQ ID NO: 1948 - protein, 120 aa, Artificial Sequence
  Description of Artificial Sequence: Synthetic polypeptide
EVQLLESGGGLVQPGGSLRLSCAASGFTFSRYGMTWVRQAPGKGLEWVSGISPSGGNTWYADSVKGRFTISRDNSKNTLYLQMNSLRAEDTAVYYCTSHDYGDHYGMDVWGQGTLVTVSS

SEQ ID NO: 1949 - protein, 120 aa, Artificial Sequence
  Description of Artificial Sequence: Synthetic polypeptide
EVQLLESGGGLVQPGGSLRLSCAASGFTFSGYDMKWVRQAPGKGLEWVSYISSSGGPTVYADSVKGRFTISRDNSKNTLYLQMNSLRAEDTAVYYCATELYDSSGYLSLWGQGTLVTVSS

SEQ ID NO: 1950 - protein, 122 aa, Artificial Sequence; identical to SEQ ID NO: 670
  Description of Artificial Sequence: Synthetic polypeptide

SEQ ID NO: 1951 - protein, 116 aa, Artificial Sequence
  Description of Artificial Sequence: Synthetic polypeptide
EVQLLESGGGLVQPGGSLRLSCAASGFTFSQYPMVWVRQAPGKGLEWVSSIYPSGGYTIYADSVKGRFTISRDNSKNTLYLQMNSLRAEDTAVYYCARGGGNFDYWGQGTLVTVSS

SEQ ID NO: 1952 - protein, 120 aa, Artificial Sequence
  Description of Artificial Sequence: Synthetic polypeptide
EVQLLESGGGLVQPGGSLRLSCAASGFTFSWYNMFWVRQAPGKGLEWVSYISPSGGPTDYADSVKGRFTISRDNSKNTLYLQMNSLRAEDTAVYYCASEYRGNYYGMDVWGQGTTVTVSS

SEQ ID NO: 1953 - protein, 120 aa, Artificial Sequence
  Description of Artificial Sequence: Synthetic polypeptide
EVQLLESGGGLVQPGGSLRLSCAASGFTFSMYYMMWVRQAPGKGLEWVSGIYPSGGPTGYADSVKGRFTISRDNSKNTLYLQMNSLRAEDTAMYYCASNDYGYYYGMDVWGQGTTVTVSS

SEQ ID NO: 1954 - protein, 118 aa, Artificial Sequence
  Description of Artificial Sequence: Synthetic polypeptide
EVQLLESGGGLVQPGGSLRLSCAASGFTFSYYHMHWVRQAPGKGLEWVSGIGPSGGMTYYADSVKGRFTISRDNSKNTLYLQMNSLRAEDTAVYYCARFNYYYGLDVWGQGTTVTVSS

SEQ ID NO: 1955 - protein, 120 aa, Artificial Sequence
  Description of Artificial Sequence: Synthetic polypeptide
EVQLLESGGGLVQPGGSLRLSCAASGFTFSHYQMDWVRQAPGKGLEWVSGISSSGGNTQYADSVKGRFTISRDNSKNTLYLQMNSLRAEDTAVYYCASQDYGRYYGMDVWGQGTTVTVSS

SEQ ID NO: 1956 - protein, 119 aa, Artificial Sequence
  Description of Artificial Sequence: Synthetic polypeptide
EVQLLESGGGLVQPGGSLRLSCAASGFTFSVYPMQWVRQAPGKGLEWVSGISSSGGFTMYADSVKGRFTISRDNSKNTLYLQMNSLRAEDMAVYYCARGGDSLYGMDVWGQGTHGHRLK

SEQ ID NO: 1957 - protein, 124 aa, Artificial Sequence
  Description of Artificial Sequence: Synthetic polypeptide
EVQLLESGGGLVQPGGSLRLSCAASGFTFSWYEMTWVRQAPGKGLEWVSYIGPSGGRTVYADSVKGRFTISRDNSKNTLYLQMNSLRAEDTAVYYCALVSQGEISGLPYGMDVWGQGTTVTVSS

SEQ ID NO: 1958 - protein, 120 aa, Artificial Sequence
  Description of Artificial Sequence: Synthetic polypeptide
EVQLLESGGGLVQPGGSLRLSCAASGFTFSYYLMNWVRQAPGKGLEWVSSIGSSGGFTYYADSVKGRFTISRDNSKNTLYLQMNSLRAEDTATYYCASNDYGYYYGMDVWGQGTTVTVSS

SEQ ID NO: 1959 - protein, 120 aa, Artificial Sequence
  Description of Artificial Sequence: Synthetic polypeptide
EVQLLESGGGLVQPGGSLRLSCAASGFTFSRYNMVWVRQAPGKGLEWVSSISSSGGRTKYADSVKGRFTISRDNSKNTLYLQMNSLRAEDTAVYYCVTLDLGYYYGMDVWGQGTTVTVSS

SEQ ID NO: 1960 - protein, 125 aa, Artificial Sequence
  Description of Artificial Sequence: Synthetic polypeptide
EVQLLESGGGLVQPGGSLRLSCAASGFTFSSYDMTWVRQAPGKGLEWVSGIVSSGGLTAYADSVKGRFTISRDNSKNTLYLQMNSLRAEDTAVYYCAKFNADFWSGYYNLGLDYWGQGTLVTVSS

SEQ ID NO: 1961 - protein, 127 aa, Artificial Sequence
  Description of Artificial Sequence: Synthetic polypeptide
EVQLLESGGGLVQPGGSLRLSCAASGFTFSYYQMNWVRQAPGKGLEWVSVISPSGGITIYADSVKGRFTISRDNSKNTLYLQMNSLRAEDTAVYYCATANGYYDSSGYYYKDAFDIWGQGTMVTVSS

SEQ ID NO: 1962 - protein, 127 aa, Artificial Sequence
  Description of Artificial Sequence: Synthetic polypeptide
EVQLLESGGGLVQPGGSLRLSCAASGFTFSWYGMTWVRQAPGKGLEWVSRIYSSGGQTMYADSVKGRFTISRDNSKNTLYLQMNSLRAEDTAVYYCAREAGIAAAGSYYYYYGMDVWGQGTTVTVSS

SEQ ID NO: 1963 - protein, 120 aa, Artificial Sequence
  Description of Artificial Sequence: Synthetic polypeptide
EVQLLESGGGLVQPGGSLRLSCAASGFTFSHYWMHWVRQAPGKGLEWVSSISSSGGMTYYADSVKGRFTISRDNSKNTLYLQMNSLRAEDTAVYYCTTADYGYYYGMDVWGQGTTVTVSS

SEQ ID NO: 1964 - protein, 122 aa, Artificial Sequence
  Description of Artificial Sequence: Synthetic polypeptide
EVQLLESGGGLVQPGGSLRLSCAASGFTFSLYWMKWVRQAPGKGLEWVSGISPSGGPTDYADSVKGRFTISRDNSKNTLYLQMNSLRAEDTATYYCATGDTLLWFGELTDYWGQGTLVTVSS

SEQ ID NO: 1965 - protein, 126 aa, Artificial Sequence
  Description of Artificial Sequence: Synthetic polypeptide
EVQLLESGGGLVQPGGSLRLSCAASGFTFSKYNMMWVRQAPGKGLEWVSYIWSSGGDTLYADSVKGRFTISRDNSKNTLYLQMNSLRAEDTAVYYCARVGYGYGGPLYYYYYMDVWGKGTTVTVSS

SEQ ID NO: 1966 - protein, 121 aa, Artificial Sequence
  Description of Artificial Sequence: Synthetic polypeptide
EVQLLESGGGLVQPGGSLRLSCAASGFTFSFYWMAWVRQAPGKGLEWVSSIGPSGGATDYADSVKGRFTISRDNSKNTLYLQMNSLRAEDTAVYYCARTNYYDRGGSFDIWGQGTMVTVSS

SEQ ID NO: 1967 - protein, 125 aa, Artificial Sequence
  Description of Artificial Sequence: Synthetic polypeptide
EVQLLESGGGLVQPGGSLRLSCAASGFTFSQYDMQWVRQAPGKGLEWVSRIGPSGGNTGYADSVKGRFTISRDNSKNTLYLQMNSLRAEDTAMYYCARINVYYDSSGYYYGMDVWGQGTTVTVSS

SEQ ID NO: 1968 - protein, 128 aa, Artificial Sequence
  Description of Artificial Sequence: Synthetic polypeptide
EVQLLESGGGLVQPGGSLRLSCAASGFTFSHYSMSWVRQAPGKGLEWVSVIYPSGGETDYADSVKGRFTISRDNSKNTLYLQMNSLRAEDTAVYYCTRDQGVDYGDYYFYYYYGMDVWGQGTTVTVSS

SEQ ID NO: 1969 - protein, 127 aa, Artificial Sequence
  Description of Artificial Sequence: Synthetic polypeptide
EVQLLESGGGLVQPGGSLRLSCAASGFTFSWYWMWVRQAPGKGLEWVSSIRPSGGFTKYADSVKGRFTISRDNSKNTLYLQMNSLRAEDTAVYYCAAVGWKGISTGLDYYYYYMDVWGKGTTVTVSS

SEQ ID NO: 1970 - protein, 127 aa, Artificial Sequence
  Description of Artificial Sequence: Synthetic polypeptide
EVQLLESGGGLVQPGGSLRLSCAASGFTFSAYEMIWVRQAPGKGLEWVSYIYSSGGWTSYADSVKGRFTISRDNSKNTLYLQMNSLRAEDTATYYCARRGLHYDSSGYYLGDYFDYWGQGTLVTVSS

SEQ ID NO: 1971 - protein, 131 aa, Artificial Sequence
  Description of Artificial Sequence: Synthetic polypeptide
EVQLLESGGGLVQPGGSLRLSCAASGFTFSSYHMDWVRQAPGKGLEWVSSISSSGGDTYYADSVKGRFTISRDNSKNTLYLQMNSLRAEDTAVYYCAKGLNYYDSNDYYEVPYYYYGMDVWGQGTTVTVSS

SEQ ID NO: 1972 - protein, 131 aa, Artificial Sequence
  Description of Artificial Sequence: Synthetic polypeptide
EVQLLESGGGLVQPGGSLRLSCAASGFTFSEYAMVWVRQAPGKGLEWVSSIVPSGGTTQYADSVKGRFTISRDNSKNTLYLQMNSLRAEDTAVYYCARVNVHYDILTGYYAYYYYYGMDVWGQGTTVTVSS

SEQ ID NO: 1973 - protein, 126 aa, Artificial Sequence
  Description of Artificial Sequence: Synthetic polypeptide
EVQLLESGGGLVQPGGSLRLSCAASGFTFSDYPMQWVRQAPGKGLEWVSSIGSSGGFTQYADYVKGRFTISRDNSKNTLYLQMNSLRAEDTAVYYCAKGSQDYDSSGYYYYYMDVWGKGTTVTVSS

SEQ ID NO: 1974 - protein, 127 aa, Artificial Sequence; identical to SEQ ID NO: 1970
  Description of Artificial Sequence: Synthetic polypeptide

SEQ ID NO: 1975 - protein, 120 aa, Artificial Sequence
  Description of Artificial Sequence: Synthetic polypeptide
EVQLLESGGGLVQPGGSLRLSCAASGFTFSHYTMDWVRQAPGKGLEWVSSIGPSGGITGYADSVKGRFTISRDNSKNTLYLQMNSLRAEDTATYYCATSSGWYWDYFDYWGQGTLVTVSS

SEQ ID NO: 1976 - protein, 118 aa, Artificial Sequence
  Description of Artificial Sequence: Synthetic polypeptide
EVQLLESGGGLVQPGGSLRLSCAASGFTFSKYMMHWVRQAPGKGLEWVSWIWPSGGVTMYADSVKGRFTISRDNSKNTLYLQMNSLRAEDTAVYYCARWGHYGGNDYWGQGTLVTVSS

SEQ ID NO: 1977 - protein, 120 aa, Artificial Sequence
  Description of Artificial Sequence: Synthetic polypeptide
EVQLLESGGGLVQPGGSLRLSCAASGFTFSFYSMGWVRQAPGKGLEWVSSISSSGGYTDYADSVKGRFTISRDNSKNTLYLQMNSLRAEDTAVYYCAREFSSWYSYMDVWGKGTTVTVSS

SEQ ID NO: 1978 - protein, 118 aa, Artificial Sequence
  Description of Artificial Sequence: Synthetic polypeptide
EVQLLESGGGLVQPGGSLRLSCAASGFTFSRYHMSWVRQAPGKGLEWVSSIRSSGGSTPYADSVKGRFTISRDNSKNTLYLQMNSLRAEDTAVYYCARGPQLSTFDIWGQGTMVTVSS

SEQ ID NO: 1979 - protein, 124 aa, Artificial Sequence
  Description of Artificial Sequence: Synthetic polypeptide
EVQLLESGGGLVQPGGSLRLSCAASGFTFSKYEMIWVRQAPGKGLEWVSSIYPSGGHTQYADSVKGRFTISRDNSNTLYLQMNSLRAEDTAVYYCARGFYGDYDYYYYYGMDVWGQGTTVTVSS

SEQ ID NO: 1980 - protein, 123 aa, Artificial Sequence
  Description of Artificial Sequence: Synthetic polypeptide
EVQLLESGGGLVQPGGSLRLSCAASGFTFSWYEMYWVRQAPGKGLEWVSWIGPSGGFTHYADSVKGRFTISRDNSKNTLYLQMNSLRAEDTALYYCATRGYSYDFEGWYFDLWGRGTLVTVSS

SEQ ID NO: 1981 - protein, 126 aa, Artificial Sequence
  Description of Artificial Sequence: Synthetic polypeptide
EVQLLESGGGLVQPGGSLRLSCAASGFTFSDYKMQWVRQAPGKGLEWVSVISSSGGHTAYADSVKGRFTISRDNSKNTLYLQMNSLRAEDTAVYYCARETYYYDSSGYYGGAFDIWGQGTMVTVSS

SEQ ID NO: 1982 - protein, 122 aa, Artificial Sequence
  Description of Artificial Sequence: Synthetic polypeptide
EVQLLESGGGLVQPGGSLRLSCAASGFTFSNYMMLWVRQAPGKGLEWVSSIWSSGGYTEYADSVKGRFTISRDNSKNTLYLQMNSLRAEDTAVYYCARGDMTTVVRNAFDIWGQGTMVTVSS

SEQ ID NO: 1983 - protein, 128 aa, Artificial Sequence
  Description of Artificial Sequence: Synthetic polypeptide
EVQLLESGGGLVQPGGSLRLSCAASGFTFSGYGMWWVRQAPGKGLEWVSSIGSSGGFTVYADSVKGRFTISRDNSKNTLYLQMNSLRAEDTAMYYCARGYHYYDSSGYYYGFEAFDIWGQGTMVTVSS

SEQ ID NO: 1984 - protein, 120 aa, Artificial Sequence
  Description of Artificial Sequence: Synthetic polypeptide
EVQLLESGGGLVQPGGSLRLSCAASGFTFSGYDMAWVRQAPGKGLEWVSSIGPSGGGTMYADSVKGRFTISRDNSKNTLYLQMNSLRAEDTAMYYCARRMESYYDSYDYWGQGTLVTVSS

SEQ ID NO: 1985 - protein, 123 aa, Artificial Sequence
  Description of Artificial Sequence: Synthetic polypeptide
EVQLLESGGGLVQPGGSLRLSCAASGFTFSWYDMRWVRQAPGKGLEWVSSISPSGGVTTYADSVKGRFTISRDNSKNTLYLQMNSLRAEDTAVYYCTTDELSWDGDPYYMDVWGKGTTVTVSS

SEQ ID NO: 1986 - protein, 120 aa, Artificial Sequence
  Description of Artificial Sequence: Synthetic polypeptide
EVQLLESGGGLVQPGGSLRLSCAASGFTFSVYDMIWVRQAPGKGLEWVSYISSSGGGTEYADSVKGRFTISRDNSKNTLYLQMNSLRAEDTAVYYCARGGSYYETAFDIWGQGTMVTVSS

SEQ ID NO: 1987 - protein, 127 aa, Artificial Sequence
  Description of Artificial Sequence: Synthetic polypeptide
EVQLLESGGGLVQPGGSLRLSCAASGFTFSNYVMSWVRQAPGKGLEWVSSIGSSGGETAYADSVKGRFTISRDNSKNTLYLQMNSLRAEDTAVYYCATVYSYDNSGRLYSFYSFYSWGQGTLVTVSS

SEQ ID NO: 1988 - protein, 122 aa, Artificial Sequence
  Description of Artificial Sequence: Synthetic polypeptide
EVQLLESGGGLVQPGGSLRLSCAASGFTFSYYNMMWVRQAPGKGLEWVSSISSSGGGTDYADSVKGRFTISRDNSKNTLYLQMNSLRAEDTAVYYCTRLGQWSSGQYYFDYWGQGTLVTVSS

SEQ ID NO: 1989 - protein, 120 aa, Artificial Sequence
  Description of Artificial Sequence: Synthetic polypeptide
EVQLLESGGGLVQPGGSLRLSCAASGFTFSYYYMVWVRQAPGKGLEWVSSIGSSGGDTLYADSVKGRFTISRDNSKNTLYLQMNSLRAEDTAVYYCARVIDSWATAFDIWGQGTMVTVSS

SEQ ID NO: 1990 - protein, 121 aa, Artificial Sequence
  Description of Artificial Sequence: Synthetic polypeptide
EVQLLESGGGLVQPGGSLRLSCAASGFTFSEYQMGWVRQAPGKGLEWVSSIVPSGGLTKYADSVKGRFTISRDNSKNTLYLQMNSLRAEDTAVYYCARGSGYYKDSHFDYWGQGTLVTVSS

SEQ ID NO: 1991 - protein, 127 aa, Artificial Sequence; identical to SEQ ID NO: 1970
  Description of Artificial Sequence: Synthetic polypeptide

SEQ ID NO: 1992 - protein, 125 aa, Artificial Sequence
  Description of Artificial Sequence: Synthetic polypeptide
EVQLLESGGGLVQPGGSLRLSCAASGFTFSIYEMEWVRQAPGKGLEWVSVISPSGGGTDYADSVKGRFTISRDNSKNTLYLQMNSLRAEDTATYYCARVRWDDFWTGYYYGMDVWGQGTTVTVSS

SEQ ID NO: 1993 - protein, 119 aa, Artificial Sequence
  Description of Artificial Sequence: Synthetic polypeptide
EVQLLESGGGLVQPGGSLRLSCAASGFTFSNYAMQWVRQAPGKGLEWVSSIWPSGGLTDYADSVKGRFTISRDNSKNTLYLQMNSLRAEDTAVYYCAREGISYDAFDIWGQGTMVTVSS

SEQ ID NO: 1994 - protein, 123 aa, Artificial Sequence
  Description of Artificial Sequence: Synthetic polypeptide
EVQLLESGGGLVQPGGSLRLSCAASGFTFSQYTMAWVRQAPGKGLEWVSGIYSSGGGTHYADSVKGRFTISRDNSKNTLYLQMNSLRAEDTAVYYCARGGGSSWYFGDAFDIWGQGTMVTVSS

SEQ ID NO: 1995 - protein, 126 aa, Artificial Sequence
  Description of Artificial Sequence: Synthetic polypeptide
EVQLLESGGGLVQPGGSLRLSCAASGFTFSAYAMYWVRQAPGKGLEWVSGISPSGGGTEYADSVKGRFTISRDNSKNTLYLQMNSLRAEDTAVYYCAREAHYYDSSGYYSGAFDIWGQGTMVTVSS

SEQ ID NO: 1996 - protein, 127 aa, Artificial Sequence
  Description of Artificial Sequence: Synthetic polypeptide
EVQLLESGGGLVQPGGSLRLSCAASGFTFSLYYMVWVRQAPGKGLEWVSGIYPSGGVTSYADSVKGRFTISRDNSKNTLYLQMNSLRAEDTAVYYCTTANGYYDSSGYYYKDAFDIWGQGTMVTVSS

SEQ ID NO: 1997 - protein, 120 aa, Artificial Sequence
  Description of Artificial Sequence: Synthetic polypeptide
EVQLLESGGGLVQPGGSLRLSCAASGFTFSAYEMRWVRQAPGKGLEWVSRIGPSGGNTQYADSVKGRFTISRDNSKNTLYLQMNSLRAEDTAVYYCTAADYGDYYGMDVWGQGTTVTVSS

SEQ ID NO: 1998 - protein, 120 aa, Artificial Sequence
  Description of Artificial Sequence: Synthetic polypeptide
EVQLLESGGGLVQPGGSLRLSCAASGFTFSMYDMGWVRQAPGKGLEWVSYIGSSGGMTTYADSVKGRFTISRDNSKNTLYLQMNSLRAEDTAVYYCARRMESYYDSYDYWGQGTLVTVSS

SEQ ID NO: 1999 - protein, 116 aa, Artificial Sequence
  Description of Artificial Sequence: Synthetic polypeptide
EVQLLESGGGLVQPGGSLRLSCAASGFTFSSYMMWVRQAPGKGLEWVSYISPSGGTTSYADSVKGRFTISRDNSKNTLYLQMNSLRAEDTAVYYCAHSWGSRFDPWGQGTLVTVSS

SEQ ID NO: 2000 - protein, 119 aa, Artificial Sequence
  Description of Artificial Sequence: Synthetic polypeptide
EVQLLESGGGLVQPGGSLRLSCAASGFTFSYYQMMWVRQAPGKGLEWVSSIGPSGLTEYADSVKGRFTISRDNSKNTLYLQMNSLRAEDTAVYYCARDGATYYDFWDYWGQGTLVTVSS

SEQ ID NO: 2001 - protein, 118 aa, Artificial Sequence
  Description of Artificial Sequence: Synthetic polypeptide
EVQLLESGGGLVQPGGSLRLSCAASGFTFSPYAMYWVRQAPGKGLEWVSSIWPSGGSTNYADSVKGRFTISRDNSKNTLYLQMNSLRAEDTAVYYCARESEIDAFDIWGQGTMVTVSS

SEQ ID NO: 2002 - protein, 127 aa, Artificial Sequence; identical to SEQ ID NO: 1970
  Description of Artificial Sequence: Synthetic polypeptide

SEQ ID NO: 2003 - protein, 133 aa, Artificial Sequence
  Description of Artificial Sequence: Synthetic polypeptide
EVQLLESGGGLVQPGGSLRLSCAASGFTFSWYYMAWVRQAPGKGLEWVSVIGPSGGDTKYADSVKGRFTISRDNSKNTLYLQMNSLRAEDTAVYYCTRVSPLDYYDSSGYYFGYYYYYGMDVWGQGTTVTVSS

SEQ ID NO: 2004 - protein, 127 aa, Artificial Sequence; identical to SEQ ID NO: 1970
  Description of Artificial Sequence: Synthetic polypeptide

SEQ ID NO: 2005 - protein, 120 aa, Artificial Sequence
  Description of Artificial Sequence: Synthetic polypeptide
EVQLLESGGGLVQPGGSLRLSCAASGFTFSFYGMGWVRQAPGKGLEWVSWISSSGGDTYYADSVKGRFTISRDNSKNTLYLQMNSLRAEDTAVYYCARDRDNWNDAADYWGQGTLVTVSS

SEQ ID NO: 2006 - protein, 118 aa, Artificial Sequence
  Description of Artificial Sequence: Synthetic polypeptide
EVQLLESGGGLVQPGGSLRLSCAASGFTFSLYPMSWVRQAPGKGLEWVSSISSSGGHTKYADSVKGRFTISRDNSKNTLYLQMNSLRAEDTAVYYCALYSYYYGMDVWGQGTTVTVSS

SEQ ID NO: 2007 - protein, 127 aa, Artificial Sequence
  Description of Artificial Sequence: Synthetic polypeptide
EVQLLESGGGLVQPGGSLRLSCAASGFTFSVYGMNWVRQAPGKGLEWVSYISPSGGTYYADSVKGRFTISRDNSKNTLYLQMNSLRAEDTAVYYCARGGYYSNSLDFYYYYYGMDVWGQGTTVTVSS

SEQ ID NO: 2008 - protein, 127 aa, Artificial Sequence
  Description of Artificial Sequence: Synthetic polypeptide
EVQLLESGGGLVQPGGSLRLSCAASGFTFSNYAMQWVRQAPGKGLEWVSYIGPSGGETGYADSVKGRFTISRDNSKNTLYLQMNSLRAEDTAVYYCARDLRGNYYDSSGYTDAFDIWGQGTMVTVSS

SEQ ID NO: 2009 - protein, 108 aa, Artificial Sequence
  Description of Artificial Sequence: Synthetic polypeptide
QDIQMTQSPSSLSASVGDRITISCQASQDIDNYLNWYQQRSGKAPKLLIYDAYNLKAGVPSRFRGSRSGTDFFLTISSLQPEDFATYYCQQSYRAPLTFGGGTKVEIK

SEQ ID NO: 2010 - protein, 108 aa, Artificial Sequence
  Description of Artificial Sequence: Synthetic polypeptide
QDIQMTQSPSSLSASVGDRVTITCQASQDTYNRLHWYQQKPGKAPKLLIYDAVNLNRGVPSRFRGSGSGTNYILIITNLQPEDTATYYCQHSDDLSLAFGGGTKVEIK

SEQ ID NO: 2011 - protein, 109 aa, Artificial Sequence
  Description of Artificial Sequence: Synthetic polypeptide
QDIQMTQSPATLSLSPGERATLSCRASHSVDNLAWYQQQPGQAPRLLIYDVSYRATGIPARFSGSGSGTDFTLTISSLEPEDFAVYYCQQRNNWPLSLTFGGGTKVEIK

SEQ ID NO: 2012 - protein, 109 aa, Artificial Sequence
  Description of Artificial Sequence: Synthetic polypeptide
QDIQMTQSPATLSLSPGERATLSCGASQNIDGYYLAWYQQKPGQAPSLLIYDASSRSTGVPDRFSGSGSGTDFTLTISRLEPEDFAVYYCQHYGNSLWTFGQGTKVEIK

SEQ ID NO: 2013 - protein, 110 aa, Artificial Sequence
  Description of Artificial Sequence: Synthetic polypeptide
QYELTQPPSASGTPGQRITISCSGSSSNLGSNPVQWYQQLPGSAPKLLIHTNTHRPSGVPDRFSGSKSVTSASLAISGLQSEDEAEYYCATWDDSLNGGVFGGGTKLTVL

SEQ ID NO: 2014 - protein, 108 aa, Artificial Sequence
  Description of Artificial Sequence: Synthetic polypeptide
QDIQMTQSPSSLSASVRDRVTITCRTSQNINTYLNWYYQAPGRAPKLLIFGVSSLHRGVSSRFSGSGDGTEFTLTISSLQPEDIGTYFCQQSYSSPWTFGQGTKVEIK

SEQ ID NO: 2015 - protein, 108 aa, Artificial Sequence; identical to SEQ ID NO: 1889
  Description of Artificial Sequence: Synthetic polypeptide

SEQ ID NO: 2016 - protein, 110 aa, Artificial Sequence
  Description of Artificial Sequence: Synthetic polypeptide
QYELTQPRSVSGSPGQSVTISCTGSSSDVAGFYYVSWYQQHPGKAPKLMIRDVNDRPSGVSNRFSGSKSGNTASLTIAGLQTEDEAVYYCSSTSRSDTRVIFGGGTKLTV

SEQ ID NO: 2017 - protein, 108 aa, Artificial Sequence
  Description of Artificial Sequence: Synthetic polypeptide
QYELTQPPSVSVAPGQTATITCEGNNIASKSVHWYQQKPGQAPVLVVYDDRDRPSGISERISGSNSGNTPTLTIFRVEAGDEADYYCQVSDSATDHRVFGGGTKLTVL

SEQ ID NO: 2018 - protein, 107 aa, Artificial Sequence
  Description of Artificial Sequence: Synthetic polypeptide
QDIQMTQSPATLSVSPGERATLSCRASQNVRNYLAWYQQKPGQAPRLLIYDASKRATGIPARFSGSGSGTDFTLTISGLEPEDFAVYYCQQRSNWPTFGPGTKVDIK

SEQ ID NO: 2019 - protein, 108 aa, Artificial Sequence
  Description of Artificial Sequence: Synthetic polypeptide
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSLTFGGGTKVEIK

SEQ ID NO: 2020 - protein, 109 aa, Artificial Sequence
  Description of Artificial Sequence: Synthetic polypeptide
QDIQMTQSPDTLSLSPGERGTLSCRASQSLSSSYLAWYQQKPGQAPRLLIYDASSRATGIPDRFSGSGSGTDFTLTIGRLEPEDSAVYYCQQYGSFPLTFGGGTKVEIK

SEQ ID NO: 2021 - protein, 124 aa, Artificial Sequence
  Description of Artificial Sequence: Synthetic polypeptide
EVQLLESGGGLVQPGGSLRLSCAASGFTFSSYPMWWVRQAPGKGLEWVSGIVPSGGVTIYADSVKGRFTISRDNSKNTLYLQMNSLRAEDTAVYYCARVGWLASSDYYYYMDVWGKGTTVTVSS

SEQ ID NO: 2022 - protein, 126 aa, Artificial Sequence
  Description of Artificial Sequence: Synthetic polypeptide
EVQLLESGGGLVQPGGSLRLSCAASGFTFSWYHMFWVRQAPGKGLEWVSGISSSGGYTHYADSVKGRFTISRDNSKNTLYLQMNSLRAEDTAVYYCATREGMLYDYVWGENYMDVWGKGTTVTVSS

SEQ ID NO: 2023 - protein, 125 aa, Artificial Sequence
  Description of Artificial Sequence: Synthetic polypeptide
EVQLLESGGGLVQPGGSLRLSCAASGFTFSAYEMDWVRQAPGKGLEWVSGISSSGGPTYYADSVKGRFTISRDNSKNTLYLQMNSLRAEDTAVYYCARVGGWELLQDYYYYMDVWGKGTTVTVSS

SEQ ID NO: 2024 - protein, 125 aa, Artificial Sequence
  Description of Artificial Sequence: Synthetic polypeptide
EVQLLESGGGLVQPGGSLRLSCAASGFTFSDYSMHWVRQAPGKGLEWVSGIGPSGGPTFYADSVKGRFTISRDNSKNTLYLQMNSLRAEDTAVYYCARGEYSSSDYYYYYGMDVWGQGTTVTVSS

SEQ ID NO: 2025 - protein, 128 aa, Artificial Sequence
  Description of Artificial Sequence: Synthetic polypeptide
EVQLLESGGGLVQPGGSLRLSCAASGFTFSWYVMVWVRQAPGKGLEWVSSIYSSGGPTKYADSVKGRFTISRDNSKNTLYLQMNSLRAEDTAVYYCAKEGGVYGGPELYYYYYGMDVWGQGTTVTVSS

SEQ ID NO: 2026 - protein, 123 aa, Artificial Sequence
  Description of Artificial Sequence: Synthetic polypeptide
EVQLLESGGGLVQPGGSLRLSCAASGFTFSEYQMAWVRQAPGKGLEWVSSIYPSGGHTHYADSVKGRFTISRDNSKNTLYLQMNSLRAEDTAVYYCAKESYYDFWSGYYFDYWGQGTLVTVSS

SEQ ID NO: 2027 - protein, 127 aa, Artificial Sequence
  Description of Artificial Sequence: Synthetic polypeptide
EVQLLESGGGLVQPGGSLRLSCAASGFTFSWYAMSWVRQAPGKGLEWVSRIVPSGGDTGYADSVKGRFTISRDNSKNTLYLQMNSLRAEDTAVYYCATFRGIMYGDYGSSYWYFDLWGRGTLVTVSS

SEQ ID NO: 2028 - protein, 129 aa, Artificial Sequence
  Description of Artificial Sequence: Synthetic polypeptide
EVQLLESGGGLVQPGGSLRLSCAASGFTFSWYAMVWVRQAPGKGLEWVSYIGSSGGVTGYADSVKGRFTISRDNSKNTLYLQMNSLRAEDTAVYYCARQKRVDYYDSSGYPTNAEFDYWGQGTLVTVSS

SEQ ID NO: 2029 - protein, 125 aa, Artificial Sequence
  Description of Artificial Sequence: Synthetic polypeptide
EVQLLESGGGLVQPGGSLRLSCAASGFTFSHYVMHWVRQAPGKGLEWVSYIGSSGGETRYADSVKGRFTISRDNSKNTLYLQMNSLRAEDTAVYYCARADYGDYDYYYYYGMDVWGQGTTVTVSS

SEQ ID NO: 2030 - protein, 119 aa, Artificial Sequence
  Description of Artificial Sequence: Synthetic polypeptide
EVQLLESGGGLVQPGGSLRLSCAASGFTFSIYQMWWVRQAPGKGLEWVSSISSSGFTWYADSVKGRFTISRDNSKNTLYLQMNSLRAEDTAVYYCTTEDIGYYYGMDVWGQGTTVTVSS

SEQ ID NO: 2031 - protein, 120 aa, Artificial Sequence
  Description of Artificial Sequence: Synthetic polypeptide
EVQLLESGGGLVQPGGSLRLSCAASGFTFSSYGMHWVRQAPGKGLEWVSGIVSSGGSTIYADSVKGRFTISRDNSKNTLYLQMNSLRAEDTAVYYCTTYDYGDHYGMDVWGQGTTVTVSS

SEQ ID NO: 2032 - protein, 125 aa, Artificial Sequence
  Description of Artificial Sequence: Synthetic polypeptide
EVQLLESGGGLVQPGGSLRLSCAASGFTFSHYEMEWVRQAPGKGLEWVSSISSSGGPTMYADSVKGRFTISRDNSKNTLYLQMNSLRAEDTAVYYCARGMYGDYDFYYYYGMDVWGQGTTVTVSS

SEQ ID NO: 2033 - protein, 22 aa, Artificial Sequence
  Description of Artificial Sequence: Synthetic peptide
QSELTQPASVSGSPGQSITISC

SEQ ID NO: 2034 - protein, 24 aa, Artificial Sequence
  Description of Artificial Sequence: Synthetic peptide
QDIQMTQSPATLSLSPGERATLSC

SEQ ID NO: 2035 - protein, 22 aa, Artificial Sequence
  Description of Artificial Sequence: Synthetic peptide
QYELTQPASVSGSPGQSITISC

SEQ ID NO: 2036 - protein, 24 aa, Artificial Sequence
  Description of Artificial Sequence: Synthetic peptide
QDIQMTQSPSSLSASVGDRVTITC

SEQ ID NO: 2037 - protein, 24 aa, Artificial Sequence
  Description of Artificial Sequence: Synthetic peptide
QDIQMTQSPSSLSASVGDRVTLTC

SEQ ID NO: 2038 - protein, 24 aa, Artificial Sequence
  Description of Artificial Sequence: Synthetic peptide
QDIQMTQSPLSLPVTPGEPASISC

SEQ ID NO: 2039 - protein, 24 aa, Artificial Sequence
  Description of Artificial Sequence: Synthetic peptide
QDIQMTQSPSSLSASVGDRVSITC

SEQ ID NO: 2040 - protein, 22 aa, Artificial Sequence
  Description of Artificial Sequence: Synthetic peptide
QSVLTQPPSASGTPGQRVTISC

SEQ ID NO: 2041 - protein, 24 aa, Artificial Sequence
  Description of Artificial Sequence: Synthetic peptide
QDIQMTQSPGTLSLSSGERATLSC

SEQ ID NO: 2042 - protein, 22 aa, Artificial Sequence
  Description of Artificial Sequence: Synthetic peptide
QSELTQPPSASGTPGQRVTISC

SEQ ID NO: 2043 - protein, 22 aa, Artificial Sequence
  Description of Artificial Sequence: Synthetic peptide
QYELTQPASVSGSPGQSITISC

SEQ ID NO: 2044 - protein, 22 aa, Artificial Sequence
  Description of Artificial Sequence: Synthetic peptide
QSALTQSSSASASLGSSVTLTC

SEQ ID NO: 2045 - protein, 24 aa, Artificial Sequence
  Description of Artificial Sequence: Synthetic peptide
QDIQMTQSPSSLSASVGDRVAITC

SEQ ID NO: 2046 - protein, 22 aa, Artificial Sequence
  Description of Artificial Sequence: Synthetic peptide
QSALTQSSSASASLGSSVTLTC

SEQ ID NO: 2047 - protein, 24 aa, Artificial Sequence
  Description of Artificial Sequence: Synthetic peptide
QDIQMTQSPDSLSASVGDRVTITC

SEQ ID NO: 2048 - protein, 22 aa, Artificial Sequence
  Description of Artificial Sequence: Synthetic peptide
QSALTQPASVSGSPGQSITISC

SEQ ID NO: 2049 - protein, 24 aa, Artificial Sequence
  Description of Artificial Sequence: Synthetic peptide
QDIQMTQSPSSLSASVGDRVTITC

SEQ ID NO: 2050 - protein, 22 aa, Artificial Sequence
  Description of Artificial Sequence: Synthetic peptide
QYELTQPPSLSVSPGQTASITC

SEQ ID NO: 2051 - protein, 24 aa, Artificial Sequence
  Description of Artificial Sequence: Synthetic peptide
QNIQMTQSPSSVSASVGDRVTITC

SEQ ID NO: 2052 - protein, 22 aa, Artificial Sequence
  Description of Artificial Sequence: Synthetic peptide
QSELTQPASVSGSPGQSITISC

SEQ ID NO: 2053 - protein, 24 aa, Artificial Sequence
  Description of Artificial Sequence: Synthetic peptide
QDIQMTQSPLSLPVTPGEPASISC

SEQ ID NO: 2054 - protein, 22 aa, Artificial Sequence
  Description of Artificial Sequence: Synthetic peptide
QYELTQPASVSGSPGQSITISC

SEQ ID NO: 2055 - protein, 22 aa, Artificial Sequence
  Description of Artificial Sequence: Synthetic peptide
QSVLTQPPSVSVAPGQTARITC

SEQ ID NO: 2056 - protein, 24 aa, Artificial Sequence
  Description of Artificial Sequence: Synthetic peptide
QDIQMTQSPSSLSASVGDRVTITC

SEQ ID NO: 2057 - protein, 22 aa, Artificial Sequence
  Description of Artificial Sequence: Synthetic peptide
QSELTQPHSVSESPGTTVTISC

SEQ ID NO: 2058 - protein, 24 aa, Artificial Sequence
  Description of Artificial Sequence: Synthetic peptide
QDIQMTQSPSTLSASVGDRVTITC

SEQ ID NO: 2059 - protein, 14 aa, Artificial Sequence
  Description of Artificial Sequence: Synthetic peptide
TGTSSDVGGYNYLS

SEQ ID NO: 2060 - protein, 12 aa, Artificial Sequence
  Description of Artificial Sequence: Synthetic peptide
RASQSVSSSYLA

SEQ ID NO: 2061 - protein, 14 aa, Artificial Sequence
  Description of Artificial Sequence: Synthetic peptide
TGTSSDVGGYNYVS

SEQ ID NO: 2062 - protein, 11 aa, Artificial Sequence
  Description of Artificial Sequence: Synthetic peptide
RASQRIASYLN

SEQ ID NO: 2063 - protein, 11 aa, Artificial Sequence
  Description of Artificial Sequence: Synthetic peptide
RTSENVERYLN

SEQ ID NO: 2064 - protein, 16 aa, Artificial Sequence
  Description of Artificial Sequence: Synthetic peptide
RSSQSLLHDNGYNYLD

SEQ ID NO: 2065 - protein, 11 aa, Artificial Sequence
  Description of Artificial Sequence: Synthetic peptide
RASQNINSYLN

SEQ ID NO: 2066 - protein, 13 aa, Artificial Sequence
  Description of Artificial Sequence: Synthetic peptide
SGTSPNIGSNTVS

SEQ ID NO: 2067 - protein, 12 aa, Artificial Sequence
  Description of Artificial Sequence: Synthetic peptide
RASQSVSSNYLA

SEQ ID NO: 2068 - protein, 13 aa, Artificial Sequence
  Description of Artificial Sequence: Synthetic peptide
SGSSSNIGSNTVN

SEQ ID NO: 2069 - protein, 14 aa, Artificial Sequence
  Description of Artificial Sequence: Synthetic peptide
TGTNSDIGDYNFVS

SEQ ID NO: 2070 - protein, 12 aa, Artificial Sequence
  Description of Artificial Sequence: Synthetic peptide
TLSSGHGDYIIA

SEQ ID NO: 2071 - protein, 11 aa, Artificial Sequence
  Description of Artificial Sequence: Synthetic peptide
RASQSIDTYLN

SEQ ID NO: 2072 - protein, 12 aa, Artificial Sequence
  Description of Artificial Sequence: Synthetic peptide
TLSSGHGDYIIA

SEQ ID NO: 2073 - protein, 11 aa, Artificial Sequence
  Description of Artificial Sequence: Synthetic peptide
RASQSISTYLN

SEQ ID NO: 2074 - protein, 14 aa, Artificial Sequence
  Description of Artificial Sequence: Synthetic peptide
TGTSSDVGGYNYVS

SEQ ID NO: 2075 - protein, 11 aa, Artificial Sequence
  Description of Artificial Sequence: Synthetic peptide
RASQRISSYLN

SEQ ID NO: 2076 - protein, 11 aa, Artificial Sequence
  Description of Artificial Sequence: Synthetic peptide
SGEKLGEKFAS

SEQ ID NO: 2077 - protein, 11 aa, Artificial Sequence
  Description of Artificial Sequence: Synthetic peptide
RASQDINYWLA

SEQ ID NO: 2078 - protein, 14 aa, Artificial Sequence
  Description of Artificial Sequence: Synthetic peptide
TGTSSDVGAYNYVS

SEQ ID NO: 2079 - protein, 16 aa, Artificial Sequence
  Description of Artificial Sequence: Synthetic peptide
RSSQSLLYSNGYNYLD

SEQ ID NO: 2080 - protein, 14 aa, Artificial Sequence
  Description of Artificial Sequence: Synthetic peptide
TGTSSDIGGYNFVS

SEQ ID NO: 2081 - protein, 11 aa, Artificial Sequence
  Description of Artificial Sequence: Synthetic peptide
GGNNIGSKTVN

SEQ ID NO: 2082 - protein, 11 aa, Artificial Sequence
  Description of Artificial Sequence: Synthetic peptide
RASQSISYFLN

SEQ ID NO: 2083 - protein, 13 aa, Artificial Sequence
  Description of Artificial Sequence: Synthetic peptide
TSSSGNIASNYVQ

SEQ ID NO: 2084 - protein, 11 aa, Artificial Sequence
  Description of Artificial Sequence: Synthetic peptide
RASQSISSWLA

SEQ ID NO: 2085 - protein, 15 aa, Artificial Sequence
  Description of Artificial Sequence: Synthetic peptide
WYQQHPGKAPKLMIY

SEQ ID NO: 2086 - protein, 15 aa, Artificial Sequence
  Description of Artificial Sequence: Synthetic peptide
WYQQKPGQAPRLLIY

SEQ ID NO: 2087 - protein, 15 aa, Artificial Sequence
  Description of Artificial Sequence: Synthetic peptide
WYQQHPGKAPKLMIY

SEQ ID NO: 2088 - protein, 15 aa, Artificial Sequence
  Description of Artificial Sequence: Synthetic peptide
WYQQKPGKAPKLLIY

SEQ ID NO: 2089 - protein, 15 aa, Artificial Sequence
  Description of Artificial Sequence: Synthetic peptide
WYQHRPGKSPRLVIY

SEQ ID NO: 2090 - protein, 15 aa, Artificial Sequence
  Description of Artificial Sequence: Synthetic peptide
WYLQKPGQSPQLLIY

SEQ ID NO: 2091 - protein, 15 aa, Artificial Sequence
  Description of Artificial Sequence: Synthetic peptide
WYQQKVGKAPKLLIF

SEQ ID NO: 2092 - protein, 15 aa, Artificial Sequence
  Description of Artificial Sequence: Synthetic peptide
WYQQLPGTAPKLLIY

SEQ ID NO: 2093 - protein, 15 aa, Artificial Sequence
  Description of Artificial Sequence: Synthetic peptide
WYQQKRGQAPRLLIY

SEQ ID NO: 2094 - protein, 15 aa, Artificial Sequence
  Description of Artificial Sequence: Synthetic peptide
WYQQLPGTAPKLLIY

SEQ ID NO: 2095 - protein, 15 aa, Artificial Sequence
  Description of Artificial Sequence: Synthetic peptide
WYQQHPGKAPKLMIS

SEQ ID NO: 2096 - protein, 14 aa, Artificial Sequence
  Description of Artificial Sequence: Synthetic peptide
WHQQQPGKAPRYLM

SEQ ID NO: 2097 - protein, 15 aa, Artificial Sequence
  Description of Artificial Sequence: Synthetic peptide
WYQQKPGKAPKLLIY

SEQ ID NO: 2098 - protein, 14 aa, Artificial Sequence
  Description of Artificial Sequence: Synthetic peptide
WHQQQPGKAPRYLM

SEQ ID NO: 2099 - protein, 15 aa, Artificial Sequence
  Description of Artificial Sequence: Synthetic peptide
WYQQKPGKAPKLLIY

SEQ ID NO: 2100 - protein, 15 aa, Artificial Sequence
  Description of Artificial Sequence: Synthetic peptide
WYQQHPGKTPKLMIY

SEQ ID NO: 2101 - protein, 15 aa, Artificial Sequence
  Description of Artificial Sequence: Synthetic peptide
WYQQKPGKAPKLLIY

SEQ ID NO: 2102 - protein, 15 aa, Artificial Sequence
  Description of Artificial Sequence: Synthetic peptide
WYQRRPGQSPLLIIY

SEQ ID NO: 2103 - protein, 15 aa, Artificial Sequence
  Description of Artificial Sequence: Synthetic peptide
WYQQKPGKAPKLLIY

SEQ ID NO: 2104 - protein, 15 aa, Artificial Sequence
  Description of Artificial Sequence: Synthetic peptide
WYQQHPGKVPKLMIY

SEQ ID NO: 2105 - protein, 15 aa, Artificial Sequence
  Description of Artificial Sequence: Synthetic peptide
WYLQKPGQSPQLLIY

SEQ ID NO: 2106 - protein, 15 aa, Artificial Sequence
  Description of Artificial Sequence: Synthetic peptide
WYQQHPGRAPKLTIY

SEQ ID NO: 2107 - protein, 15 aa, Artificial Sequence
  Description of Artificial Sequence: Synthetic peptide
WYQQKTGQAPVLVVH

SEQ ID NO: 2108 - protein, 15 aa, Artificial Sequence
  Description of Artificial Sequence: Synthetic peptide
WYQQKPGKAPKLLIY

SEQ ID NO: 2109 - protein, 15 aa, Artificial Sequence
  Description of Artificial Sequence: Synthetic peptide
WYQQRPNSAPTIVIY

SEQ ID NO: 2110 - protein, 15 aa, Artificial Sequence
  Description of Artificial Sequence: Synthetic peptide
WYQQKPGKAPKLLIY

SEQ ID NO: 2111 - protein, 7 aa, Artificial Sequence
  Description of Artificial Sequence: Synthetic peptide
EVTNRPS

SEQ ID NO: 2112 - protein, 7 aa, Artificial Sequence
  Description of Artificial Sequence: Synthetic peptide
GASSRAT

SEQ ID NO: 2113 - protein, 7 aa, Artificial Sequence
  Description of Artificial Sequence: Synthetic peptide
EVSNRPS

SEQ ID NO: 2114 - protein, 7 aa, Artificial Sequence
  Description of Artificial Sequence: Synthetic peptide
AASSLQS

SEQ ID NO: 2115 - protein, 7 aa, Artificial Sequence
  Description of Artificial Sequence: Synthetic peptide
DASKLQT

SEQ ID NO: 2116 - protein, 7 aa, Artificial Sequence
  Description of Artificial Sequence: Synthetic peptide
LGSNRAS

SEQ ID NO: 2117 - protein, 7 aa, Artificial Sequence
  Description of Artificial Sequence: Synthetic peptide
GAYTLHS

SEQ ID NO: 2118 - protein, 7 aa, Artificial Sequence
  Description of Artificial Sequence: Synthetic peptide
NNNQRPS

SEQ ID NO: 2119 - protein, 7 aa, Artificial Sequence
  Description of Artificial Sequence: Synthetic peptide
GASSRAT

SEQ ID NO: 2120 - protein, 7 aa, Artificial Sequence
  Description of Artificial Sequence: Synthetic peptide
SNNQRPS

SEQ ID NO: 2121 - protein, 7 aa, Artificial Sequence
  Description of Artificial Sequence: Synthetic peptide
EVSNRPS

SEQ ID NO: 2122 - protein, 12 aa, Artificial Sequence
  Description of Artificial Sequence: Synthetic peptide
KLENSGSFKKGS

SEQ ID NO: 2123 - protein, 7 aa, Artificial Sequence
  Description of Artificial Sequence: Synthetic peptide
AASKLED

SEQ ID NO: 2124 - protein, 12 aa, Artificial Sequence
  Description of Artificial Sequence: Synthetic peptide
KLENSGSFKKGS

SEQ ID NO: 2125 - protein, 7 aa, Artificial Sequence
  Description of Artificial Sequence: Synthetic peptide
AASSLQS

SEQ ID NO: 2126 - protein, 7 aa, Artificial Sequence
  Description of Artificial Sequence: Synthetic peptide
DVSNRPS

SEQ ID NO: 2127 - protein, 7 aa, Artificial Sequence
  Description of Artificial Sequence: Synthetic peptide
AASSLQS

SEQ ID NO: 2128 - protein, 7 aa, Artificial Sequence
  Description of Artificial Sequence: Synthetic peptide
QDNKRPS

SEQ ID NO: 2129 - protein, 7 aa, Artificial Sequence
  Description of Artificial Sequence: Synthetic peptide
AASSLQS

SEQ ID NO: 2130 - protein, 7 aa, Artificial Sequence
  Description of Artificial Sequence: Synthetic peptide
EVSNRPS

SEQ ID NO: 2131 - protein, 7 aa, Artificial Sequence
  Description of Artificial Sequence: Synthetic peptide
LGSNRAS

SEQ ID NO: 2132 - protein, 7 aa, Artificial Sequence
  Description of Artificial Sequence: Synthetic peptide
EVNNRPS

SEQ ID NO: 2133 - protein, 7 aa, Artificial Sequence
  Description of Artificial Sequence: Synthetic peptide
DDSDRPS

SEQ ID NO: 2134 - protein, 7 aa, Artificial Sequence
  Description of Artificial Sequence: Synthetic peptide
AASTLQG

SEQ ID NO: 2135 - protein, 7 aa, Artificial Sequence
  Description of Artificial Sequence: Synthetic peptide
AYNRRPS

SEQ ID NO: 2136 - protein, 7 aa, Artificial Sequence
  Description of Artificial Sequence: Synthetic peptide
DASSLES

SEQ ID NO: 2137 - protein, 32 aa, Artificial Sequence
  Description of Artificial Sequence: Synthetic polypeptide
GVSNRFSGSKSGNTASLTISGLQAEDEADYYC

SEQ ID NO: 2138 - protein, 32 aa, Artificial Sequence; identical to SEQ ID NO: 218
  Description of Artificial Sequence: Synthetic polypeptide

SEQ ID NO: 2139 - protein, 32 aa, Artificial Sequence; identical to SEQ ID NO: 2137
  Description of Artificial Sequence: Synthetic polypeptide

SEQ ID NO: 2140 - protein, 32 aa, Artificial Sequence
  Description of Artificial Sequence: Synthetic polypeptide
GVPSRFSGSGSGTDFTLTVSSLQPEDFATYYC

SEQ ID NO: 2141 - protein, 32 aa, Artificial Sequence
  Description of Artificial Sequence: Synthetic polypeptide
GVPSRFTGRGSGTDFTLTINSLQPEDFATYYC

SEQ ID NO: 2142 - protein, 32 aa, Artificial Sequence
  Description of Artificial Sequence: Synthetic polypeptide
GVPDRFSGSGSGTDFTLKISRVEAEDVGVYYC

SEQ ID NO: 2143 - protein, 32 aa, Artificial Sequence
  Description of Artificial Sequence: Synthetic polypeptide
GAPSRFSGSGSGTDFTLTISSLQPEDVATYYC

SEQ ID NO: 2144 - protein, 32 aa, Artificial Sequence
  Description of Artificial Sequence: Synthetic polypeptide
GVPDRFSGSKSGTSASLAISGLQSEDEADYYC

SEQ ID NO: 2145 - protein, 32 aa, Artificial Sequence
  Description of Artificial Sequence: Synthetic polypeptide
GVPGRFSGSGSGTDFTLTISRLEPEDFAVYYC

SEQ ID NO: 2146 - protein, 32 aa, Artificial Sequence; identical to SEQ ID NO: 2144
  Description of Artificial Sequence: Synthetic polypeptide

SEQ ID NO: 2147 - protein, 32 aa, Artificial Sequence
  Description of Artificial Sequence: Synthetic polypeptide
GVSNRFSGSKSGNTASLSISGLQAEDEAHYYC

SEQ ID NO: 2148 - protein, 32 aa, Artificial Sequence
  Description of Artificial Sequence: Synthetic polypeptide
GVPDRFSGSSSGADRYLTISDLQSDDEADYYC

SEQ ID NO: 2149 - protein, 32 aa, Artificial Sequence
  Description of Artificial Sequence: Synthetic polypeptide
GVPSRFSGSGTGTDFTLTIRSLQPEDFASYFC

SEQ ID NO: 2150 - protein, 32 aa, Artificial Sequence; identical to SEQ ID NO: 2148
  Description of Artificial Sequence: Synthetic polypeptide

SEQ ID NO: 2151 - protein, 32 aa, Artificial Sequence; identical to SEQ ID NO: 186
  Description of Artificial Sequence: Synthetic polypeptide

SEQ ID NO: 2152 - protein, 32 aa, Artificial Sequence; identical to SEQ ID NO: 2137
  Description of Artificial Sequence: Synthetic polypeptide

SEQ ID NO: 2153 - protein, 32 aa, Artificial Sequence
  Description of Artificial Sequence: Synthetic polypeptide
GVPSRFSGSGSGTDFTLTIRSLQPEDFATYYC

SEQ ID NO: 2154 - protein, 32 aa, Artificial Sequence
  Description of Artificial Sequence: Synthetic polypeptide
GIPERFSGSNSGNTAALTITGTQAMDDADYYC

SEQ ID NO: 2155 - protein, 32 aa, Artificial Sequence; identical to SEQ ID NO: 186
  Description of Artificial Sequence: Synthetic polypeptide

SEQ ID NO: 2156 - protein, 32 aa, Artificial Sequence; identical to SEQ ID NO: 2137
  Description of Artificial Sequence: Synthetic polypeptide

SEQ ID NO: 2157 - protein, 32 aa, Artificial Sequence; identical to SEQ ID NO: 2142
  Description of Artificial Sequence: Synthetic polypeptide

SEQ ID NO: 2158 - protein, 32 aa, Artificial Sequence; identical to SEQ ID NO: 2137
  Description of Artificial Sequence: Synthetic polypeptide

SEQ ID NO: 2159 - protein, 32 aa, Artificial Sequence
  Description of Artificial Sequence: Synthetic polypeptide
GIPERLSGSNSGNTATLTISRVEAGDEADYYC

SEQ ID NO: 2160 - protein, 32 aa, Artificial Sequence
  Description of Artificial Sequence: Synthetic polypeptide
GVPSRFRGSGSGTDFTLTISSLQPEDFATYYC

SEQ ID NO: 2161 - protein, 34 aa, Artificial Sequence
  Description of Artificial Sequence: Synthetic polypeptide
GVPDRFSGSIDSSSNSASLTVSGLKTEDEADYYC

SEQ ID NO: 2162 - protein, 32 aa, Artificial Sequence
  Description of Artificial Sequence: Synthetic polypeptide
GVPSRFSGSGSGTEFTLTISSLQPEDIGTYYC

SEQ ID NO: 2163 - protein, 10 aa, Artificial Sequence
  Description of Artificial Sequence: Synthetic peptide
SSYTSTTTLL

SEQ ID NO: 2164 - protein, 9 aa, Artificial Sequence
  Description of Artificial Sequence: Synthetic peptide
QQYGSSPLT

SEQ ID NO: 2165 - protein, 11 aa, Artificial Sequence
  Description of Artificial Sequence: Synthetic peptide
SSYTSSSTLFR

SEQ ID NO: 2166 - protein, 9 aa, Artificial Sequence
  Description of Artificial Sequence: Synthetic peptide
QQSYSAPLT

SEQ ID NO: 2167 - protein, 9 aa, Artificial Sequence
  Description of Artificial Sequence: Synthetic peptide
QQTSITPHT

SEQ ID NO: 2168 - protein, 9 aa, Artificial Sequence
  Description of Artificial Sequence: Synthetic peptide
MQGLQTPLT

SEQ ID NO: 2169 - protein, 8 aa, Artificial Sequence
  Description of Artificial Sequence: Synthetic peptide
QQTYTSYS

SEQ ID NO: 2170 - protein, 11 aa, Artificial Sequence
  Description of Artificial Sequence: Synthetic peptide
VAWDDSLNGFV

SEQ ID NO: 2171 - protein, 9 aa, Artificial Sequence
  Description of Artificial Sequence: Synthetic peptide
QQYGSSPRT

SEQ ID NO: 2172 - protein, 12 aa, Artificial Sequence
  Description of Artificial Sequence: Synthetic peptide
AAWDDSLNGRWV

SEQ ID NO: 2173 - protein, 11 aa, Artificial Sequence
  Description of Artificial Sequence: Synthetic peptide
SSYTSSSTPVV

SEQ ID NO: 2174 - protein, 10 aa, Artificial Sequence
  Description of Artificial Sequence: Synthetic peptide
ETWDSNIRLV

SEQ ID NO: 2175 - protein, 10 aa, Artificial Sequence
  Description of Artificial Sequence: Synthetic peptide
QQSYSSPGIT

SEQ ID NO: 2176 - protein, 10 aa, Artificial Sequence
  Description of Artificial Sequence: Synthetic peptide
ETWDSNIRLV

SEQ ID NO: 2177 - protein, 9 aa, Artificial Sequence
  Description of Artificial Sequence: Synthetic peptide
QQSYSTPLT

SEQ ID NO: 2178 - protein, 10 aa, Artificial Sequence
  Description of Artificial Sequence: Synthetic peptide
SSYTSSSTLV

SEQ ID NO: 2179 - protein, 9 aa, Artificial Sequence
  Description of Artificial Sequence: Synthetic peptide
QQSYSSRWT

SEQ ID NO: 2180 - protein, 9 aa, Artificial Sequence
  Description of Artificial Sequence: Synthetic peptide
QAWESTTAV

SEQ ID NO: 2181 - protein, 9 aa, Artificial Sequence
  Description of Artificial Sequence: Synthetic peptide
QRANSFPYT

SEQ ID NO: 2182 - protein, 10 aa, Artificial Sequence
  Description of Artificial Sequence: Synthetic peptide
NSYTTSATLV

SEQ ID NO: 2183 - protein, 9 aa, Artificial Sequence
  Description of Artificial Sequence: Synthetic peptide
MQALQTPLT

SEQ ID NO: 2184 - protein, 10 aa, Artificial Sequence
  Description of Artificial Sequence: Synthetic peptide
SSYTPSSTLV

SEQ ID NO: 2185 - protein, 11 aa, Artificial Sequence
  Description of Artificial Sequence: Synthetic peptide
QVWDSGTDHYV

SEQ ID NO: 2186 - protein, 10 aa, Artificial Sequence
  Description of Artificial Sequence: Synthetic peptide
QHSYSTPPIT

SEQ ID NO: 2187 - protein, 11 aa, Artificial Sequence
  Description of Artificial Sequence: Synthetic peptide
QSYDNINRLWV

SEQ ID NO: 2188 - protein, 8 aa, Artificial Sequence
  Description of Artificial Sequence: Synthetic peptide
QQYDHLPT

SEQ ID NO: 2189 - protein, 10 aa, Artificial Sequence
  Description of Artificial Sequence: Synthetic peptide
FGGGTKLTVL

SEQ ID NO: 2190 - protein, 10 aa, Artificial Sequence
  Description of Artificial Sequence: Synthetic peptide
FGGGTKVEIK

SEQ ID NO: 2191 - protein, 10 aa, Artificial Sequence
  Description of Artificial Sequence: Synthetic peptide
FGGGTKLTVL

SEQ ID NO: 2192 - protein, 10 aa, Artificial Sequence
  Description of Artificial Sequence: Synthetic peptide
FGGGTKVEIK

SEQ ID NO: 2193 - protein, 10 aa, Artificial Sequence
  Description of Artificial Sequence: Synthetic peptide
FGQGTKLDVK

SEQ ID NO: 2194 - protein, 10 aa, Artificial Sequence
  Description of Artificial Sequence: Synthetic peptide
FGGGTKVEIK

SEQ ID NO: 2195 - protein, 10 aa, Artificial Sequence
  Description of Artificial Sequence: Synthetic peptide
FAQGTKLEIK

SEQ ID NO: 2196 - protein, 10 aa, Artificial Sequence
  Description of Artificial Sequence: Synthetic peptide
LGTGTKVTVL

SEQ ID NO: 2197 - protein, 10 aa, Artificial Sequence
  Description of Artificial Sequence: Synthetic peptide
FGQGTKLEIK

SEQ ID NO: 2198 - protein, 10 aa, Artificial Sequence
  Description of Artificial Sequence: Synthetic peptide
FGGGTKLTVL

SEQ ID NO: 2199 - protein, 10 aa, Artificial Sequence
  Description of Artificial Sequence: Synthetic peptide
FGGGTKLTVL

SEQ ID NO: 2200 - protein, 10 aa, Artificial Sequence
  Description of Artificial Sequence: Synthetic peptide
FGGGTKLTVL

SEQ ID NO: 2201 - protein, 10 aa, Artificial Sequence
  Description of Artificial Sequence: Synthetic peptide
FGPGTKVEIK

SEQ ID NO: 2202 - protein, 10 aa, Artificial Sequence
  Description of Artificial Sequence: Synthetic peptide
FGGGTKLTVL

SEQ ID NO: 2203 - protein, 10 aa, Artificial Sequence
  Description of Artificial Sequence: Synthetic peptide
FGGGTKVEIK

SEQ ID NO: 2204 - protein, 10 aa, Artificial Sequence
  Description of Artificial Sequence: Synthetic peptide
FGGGTKLTVL

SEQ ID NO: 2205 - protein, 10 aa, Artificial Sequence
  Description of Artificial Sequence: Synthetic peptide
FGQGTKVEIQ

SEQ ID NO: 2206 - protein, 10 aa, Artificial Sequence
  Description of Artificial Sequence: Synthetic peptide
FGGGTKLTVL

SEQ ID NO: 2207 - protein, 10 aa, Artificial Sequence
  Description of Artificial Sequence: Synthetic peptide
FGQGTKLEIK

SEQ ID NO: 2208 - protein, 10 aa, Artificial Sequence
  Description of Artificial Sequence: Synthetic peptide
FGGGTKLTVL

SEQ ID NO: 2209 - protein, 10 aa, Artificial Sequence
  Description of Artificial Sequence: Synthetic peptide
FGGGTKVEIK

SEQ ID NO: 2210 - protein, 10 aa, Artificial Sequence
  Description of Artificial Sequence: Synthetic peptide
FGTGTKVTVL

SEQ ID NO: 2211 - protein, 10 aa, Artificial Sequence
  Description of Artificial Sequence: Synthetic peptide
FGTGTKVTVL

SEQ ID NO: 2212 - protein, 10 aa, Artificial Sequence
  Description of Artificial Sequence: Synthetic peptide
FGPGTKVDIK

SEQ ID NO: 2213 - protein, 10 aa, Artificial Sequence
  Description of Artificial Sequence: Synthetic peptide
FGGGTKLTVL

SEQ ID NO: 2214 - protein, 10 aa, Artificial Sequence
  Description of Artificial Sequence: Synthetic peptide
FGGGTKVQVK

SEQ ID NO: 2215 - protein, 7 aa, Artificial Sequence
  Description of Artificial Sequence: Synthetic peptide
GQPKAAP

SEQ ID NO: 2216 - protein, 7 aa, Artificial Sequence
  Description of Artificial Sequence: Synthetic peptide
RTVAAPS

SEQ ID NO: 2217 - protein, 7 aa, Artificial Sequence
  Description of Artificial Sequence: Synthetic peptide
GQPKAAP

SEQ ID NO: 2218 - protein, 7 aa, Artificial Sequence
  Description of Artificial Sequence: Synthetic peptide
RTVAAPS

SEQ ID NO: 2219 - protein, 7 aa, Artificial Sequence
  Description of Artificial Sequence: Synthetic peptide
RTVAAPS

SEQ ID NO: 2220 - protein, 7 aa, Artificial Sequence
  Description of Artificial Sequence: Synthetic peptide
RTVSAPS

SEQ ID NO: 2221 - protein, 7 aa, Artificial Sequence
  Description of Artificial Sequence: Synthetic peptide
AAPSVFI

SEQ ID NO: 2222 - protein, 7 aa, Artificial Sequence
  Description of Artificial Sequence: Synthetic peptide
GQPKANP

SEQ ID NO: 2223 - protein, 7 aa, Artificial Sequence
  Description of Artificial Sequence: Synthetic peptide
RTVAAPS

SEQ ID NO: 2224 - protein, 7 aa, Artificial Sequence
  Description of Artificial Sequence: Synthetic peptide
GQPKAAP

SEQ ID NO: 2225 - protein, 7 aa, Artificial Sequence
  Description of Artificial Sequence: Synthetic peptide
GQPKAAP

SEQ ID NO: 2226 - protein, 7 aa, Artificial Sequence
  Description of Artificial Sequence: Synthetic peptide
SQPKAAP

SEQ ID NO: 2227 - protein, 7 aa, Artificial Sequence
  Description of Artificial Sequence: Synthetic peptide
RTVAAPS

SEQ ID NO: 2228 - protein, 7 aa, Artificial Sequence
  Description of Artificial Sequence: Synthetic peptide
SQPKAAP

SEQ ID NO: 2229 - protein, 7 aa, Artificial Sequence
  Description of Artificial Sequence: Synthetic peptide
RTVAAPS

SEQ ID NO: 2230 - protein, 7 aa, Artificial Sequence
  Description of Artificial Sequence: Synthetic peptide
GQPKAAP

SEQ ID NO: 2231 - protein, 7 aa, Artificial Sequence
  Description of Artificial Sequence: Synthetic peptide
RTVAAPS

SEQ ID NO: 2232 - protein, 7 aa, Artificial Sequence
  Description of Artificial Sequence: Synthetic peptide
GQPKANP

SEQ ID NO: 2233 - protein, 7 aa, Artificial Sequence
  Description of Artificial Sequence: Synthetic peptide
RTVAAPS

SEQ ID NO: 2234 - protein, 7 aa, Artificial Sequence
  Description of Artificial Sequence: Synthetic peptide
SQPKAAP

SEQ ID NO: 2235 - protein, 7 aa, Artificial Sequence
  Description of Artificial Sequence: Synthetic peptide
RTVAAPS

SEQ ID NO: 2236 - protein, 7 aa, Artificial Sequence
  Description of Artificial Sequence: Synthetic peptide
RQPKANP

SEQ ID NO: 2237 - protein, 7 aa, Artificial Sequence
  Description of Artificial Sequence: Synthetic peptide
GQPKANP

SEQ ID NO: 2238 - protein, 7 aa, Artificial Sequence
  Description of Artificial Sequence: Synthetic peptide
RTVAAPS

SEQ ID NO: 2239 - protein, 7 aa, Artificial Sequence
  Description of Artificial Sequence: Synthetic peptide
GQPKAAP

SEQ ID NO: 2240 - protein, 7 aa, Artificial Sequence
  Description of Artificial Sequence: Synthetic peptide
RTVAAPS

SEQ ID NO: 2241 - protein, 30 aa, Artificial Sequence; identical to SEQ ID NO: 322
  Description of Artificial Sequence: Synthetic polypeptide

SEQ ID NO: 2242 - protein, 30 aa, Artificial Sequence; identical to SEQ ID NO: 322
  Description of Artificial Sequence: Synthetic polypeptide

SEQ ID NO: 2243 - protein, 30 aa, Artificial Sequence; identical to SEQ ID NO: 322
  Description of Artificial Sequence: Synthetic polypeptide

SEQ ID NO: 2244 - protein, 30 aa, Artificial Sequence; identical to SEQ ID NO: 322
  Description of Artificial Sequence: Synthetic polypeptide

SEQ ID NO: 2245 - protein, 30 aa, Artificial Sequence; identical to SEQ ID NO: 322
  Description of Artificial Sequence: Synthetic polypeptide

SEQ ID NO: 2246 - protein, 30 aa, Artificial Sequence; identical to SEQ ID NO: 322
  Description of Artificial Sequence: Synthetic polypeptide

SEQ ID NO: 2247 - protein, 30 aa, Artificial Sequence; identical to SEQ ID NO: 322
  Description of Artificial Sequence: Synthetic polypeptide

SEQ ID NO: 2248 - protein, 30 aa, Artificial Sequence; identical to SEQ ID NO: 322
  Description of Artificial Sequence: Synthetic polypeptide

SEQ ID NO: 2249 - protein, 30 aa, Artificial Sequence; identical to SEQ ID NO: 322
  Description of Artificial Sequence: Synthetic polypeptide

SEQ ID NO: 2250 - protein, 30 aa, Artificial Sequence; identical to SEQ ID NO: 322
  Description of Artificial Sequence: Synthetic polypeptide

SEQ ID NO: 2251 - protein, 30 aa, Artificial Sequence; identical to SEQ ID NO: 322
  Description of Artificial Sequence: Synthetic polypeptide

SEQ ID NO: 2252 - protein, 30 aa, Artificial Sequence; identical to SEQ ID NO: 322
  Description of Artificial Sequence: Synthetic polypeptide

SEQ ID NO: 2253 - protein, 30 aa, Artificial Sequence; identical to SEQ ID NO: 322
  Description of Artificial Sequence: Synthetic polypeptide

SEQ ID NO: 2254 - protein, 30 aa, Artificial Sequence; identical to SEQ ID NO: 322
  Description of Artificial Sequence: Synthetic polypeptide

SEQ ID NO: 2255 - protein, 30 aa, Artificial Sequence; identical to SEQ ID NO: 322
  Description of Artificial Sequence: Synthetic polypeptide

SEQ ID NO: 2256 - protein, 30 aa, Artificial Sequence; identical to SEQ ID NO: 322
  Description of Artificial Sequence: Synthetic polypeptide

SEQ ID NO: 2257 - protein, 30 aa, Artificial Sequence; identical to SEQ ID NO: 322
  Description of Artificial Sequence: Synthetic polypeptide

SEQ ID NO: 2258 - protein, 30 aa, Artificial Sequence; identical to SEQ ID NO: 322
  Description of Artificial Sequence: Synthetic polypeptide

SEQ ID NO: 2259 - protein, 30 aa, Artificial Sequence; identical to SEQ ID NO: 322
  Description of Artificial Sequence: Synthetic polypeptide

SEQ ID NO: 2260 - protein, 30 aa, Artificial Sequence; identical to SEQ ID NO: 322
  Description of Artificial Sequence: Synthetic polypeptide

SEQ ID NO: 2261 - protein, 30 aa, Artificial Sequence; identical to SEQ ID NO: 322
  Description of Artificial Sequence: Synthetic polypeptide

SEQ ID NO: 2262 - protein, 30 aa, Artificial Sequence; identical to SEQ ID NO: 322
  Description of Artificial Sequence: Synthetic polypeptide

SEQ ID NO: 2263 - protein, 30 aa, Artificial Sequence; identical to SEQ ID NO: 322
  Description of Artificial Sequence: Synthetic polypeptide

SEQ ID NO: 2264 - protein, 30 aa, Artificial Sequence; identical to SEQ ID NO: 322
  Description of Artificial Sequence: Synthetic polypeptide

SEQ ID NO: 2265 - protein, 30 aa, Artificial Sequence; identical to SEQ ID NO: 322
  Description of Artificial Sequence: Synthetic polypeptide

SEQ ID NO: 2266 - protein, 30 aa, Artificial Sequence
  Description of Artificial Sequence: Synthetic polypeptide
EVQLLESGGGLVQPGGSLRLSCAASGFTFV

SEQ ID NO: 2267 - protein, 5 aa, Artificial Sequence
  Description of Artificial Sequence: Synthetic peptide
WYPMI

SEQ ID NO: 2268 - protein, 5 aa, Artificial Sequence
  Description of Artificial Sequence: Synthetic peptide
DYGMM

SEQ ID NO: 2269 - protein, 5 aa, Artificial Sequence
  Description of Artificial Sequence: Synthetic peptide
DYPMS

SEQ ID NO: 2270 - protein, 5 aa, Artificial Sequence
  Description of Artificial Sequence: Synthetic peptide
EYAMR

SEQ ID NO: 2271 - protein, 5 aa, Artificial Sequence
  Description of Artificial Sequence: Synthetic peptide
EYNMH

SEQ ID NO: 2272 - protein, 5 aa, Artificial Sequence
  Description of Artificial Sequence: Synthetic peptide
EYNMN

SEQ ID NO: 2273 - protein, 5 aa, Artificial Sequence
  Description of Artificial Sequence: Synthetic peptide
EYPMY

SEQ ID NO: 2274 - protein, 5 aa, Artificial Sequence
  Description of Artificial Sequence: Synthetic peptide
FYAMT

SEQ ID NO: 2275 - protein, 5 aa, Artificial Sequence
  Description of Artificial Sequence: Synthetic peptide
HYWMH

SEQ ID NO: 2276 - protein, 5 aa, Artificial Sequence
  Description of Artificial Sequence: Synthetic peptide
IYMMG

SEQ ID NO: 2277 - protein, 5 aa, Artificial Sequence
  Description of Artificial Sequence: Synthetic peptide
KYPMV

SEQ ID NO: 2278 - protein, 5 aa, Artificial Sequence
  Description of Artificial Sequence: Synthetic peptide
MYAMV

SEQ ID NO: 2279 - protein, 5 aa, Artificial Sequence
  Description of Artificial Sequence: Synthetic peptide
MYPMN

SEQ ID NO: 2280 - protein, 5 aa, Artificial Sequence
  Description of Artificial Sequence: Synthetic peptide
PYDMT

SEQ ID NO: 2281 - protein, 5 aa, Artificial Sequence
  Description of Artificial Sequence: Synthetic peptide
PYIMK

SEQ ID NO: 2282 - protein, 5 aa, Artificial Sequence
  Description of Artificial Sequence: Synthetic peptide
PYSMG

SEQ ID NO: 2283 - protein, 5 aa, Artificial Sequence
  Description of Artificial Sequence: Synthetic peptide
RYGML

SEQ ID NO: 2284 - protein, 5 aa, Artificial Sequence
  Description of Artificial Sequence: Synthetic peptide
RYTMG

SEQ ID NO: 2285 - protein, 5 aa, Artificial Sequence
  Description of Artificial Sequence: Synthetic peptide
RYWMD

SEQ ID NO: 2286 - protein, 5 aa, Artificial Sequence
  Description of Artificial Sequence: Synthetic peptide
TYPMS

SEQ ID NO: 2287 - protein, 5 aa, Artificial Sequence
  Description of Artificial Sequence: Synthetic peptide
WYKMG

SEQ ID NO: 2288 - protein, 5 aa, Artificial Sequence
  Description of Artificial Sequence: Synthetic peptide
WYPMI

SEQ ID NO: 2289 - protein, 5 aa, Artificial Sequence
  Description of Artificial Sequence: Synthetic peptide
YYEME

SEQ ID NO: 2290 - protein, 5 aa, Artificial Sequence
  Description of Artificial Sequence: Synthetic peptide
YYPMA

SEQ ID NO: 2291 - protein, 5 aa, Artificial Sequence
  Description of Artificial Sequence: Synthetic peptide
YYPMV

SEQ ID NO: 2292 - protein, 4 aa, Artificial Sequence
  Description of Artificial Sequence: Synthetic peptide
YHMQ

SEQ ID NO: 2293 - protein, 14 aa, Artificial Sequence
  Description of Artificial Sequence: Synthetic peptide
WVRQAPGKGLEWVS

SEQ ID NO: 2294 - protein, 14 aa, Artificial Sequence
  Description of Artificial Sequence: Synthetic peptide
WVRQAPGKGLEWVS

SEQ ID NO: 2295 - protein, 14 aa, Artificial Sequence
  Description of Artificial Sequence: Synthetic peptide
WVRQAPGKGLEWVS

SEQ ID NO: 2296 - protein, 14 aa, Artificial Sequence
  Description of Artificial Sequence: Synthetic peptide
WVRQAPGKGLEWVS

SEQ ID NO: 2297 - protein, 14 aa, Artificial Sequence
  Description of Artificial Sequence: Synthetic peptide
WVRQAPGKGLEWVS

SEQ ID NO: 2298 - protein, 14 aa, Artificial Sequence
  Description of Artificial Sequence: Synthetic peptide
WVRQAPGKGLEWVS

SEQ ID NO: 2299 - protein, 14 aa, Artificial Sequence
  Description of Artificial Sequence: Synthetic peptide
WVRQAPGKGLEWVS

SEQ ID NO: 2300 - protein, 14 aa, Artificial Sequence
  Description of Artificial Sequence: Synthetic peptide
WVRQAPGKGLEWVS

SEQ ID NO: 2301 - protein, 14 aa, Artificial Sequence
  Description of Artificial Sequence: Synthetic peptide
WVRQAPGKGLEWVS

SEQ ID NO: 2302 - protein, 14 aa, Artificial Sequence
  Description of Artificial Sequence: Synthetic peptide
WVRQAPGKGLEWVS

SEQ ID NO: 2303 - protein, 14 aa, Artificial Sequence
  Description of Artificial Sequence: Synthetic peptide
WVRQAPGKGLEWVS

SEQ ID NO: 2304 - protein, 14 aa, Artificial Sequence
  Description of Artificial Sequence: Synthetic peptide
WVRQAPGKGLEWVS

SEQ ID NO: 2305 - protein, 14 aa, Artificial Sequence
  Description of Artificial Sequence: Synthetic peptide
WVRQAPGKGLEWVS

SEQ ID NO: 2306 - protein, 14 aa, Artificial Sequence
  Description of Artificial Sequence: Synthetic peptide
WVRQAPGKGLEWVS

SEQ ID NO: 2307 - protein, 14 aa, Artificial Sequence
  Description of Artificial Sequence: Synthetic peptide
WVRQAPGKGLEWVS

SEQ ID NO: 2308 - protein, 14 aa, Artificial Sequence
  Description of Artificial Sequence: Synthetic peptide
WVRQAPGKGLEWVS

SEQ ID NO: 2309 - protein, 14 aa, Artificial Sequence
  Description of Artificial Sequence: Synthetic peptide
WVRQAPGKGLEWVS

SEQ ID NO: 2310 - protein, 14 aa, Artificial Sequence
  Description of Artificial Sequence: Synthetic peptide
WVRQAPGKGLEWVS

SEQ ID NO: 2311 - protein, 14 aa, Artificial Sequence
  Description of Artificial Sequence: Synthetic peptide
WVRQAPGKGLEWVS

SEQ ID NO: 2312 - protein, 14 aa, Artificial Sequence
  Description of Artificial Sequence: Synthetic peptide
WVRQAPGKGLEWVS

SEQ ID NO: 2313 - protein, 14 aa, Artificial Sequence
  Description of Artificial Sequence: Synthetic peptide
WVRQAPGKGLEWVS

SEQ ID NO: 2314 - protein, 14 aa, Artificial Sequence
  Description of Artificial Sequence: Synthetic peptide
WVRQAPGKGLEWVS

SEQ ID NO: 2315 - protein, 14 aa, Artificial Sequence
  Description of Artificial Sequence: Synthetic peptide
WVRQAPGKGLEWVS

SEQ ID NO: 2316 - protein, 14 aa, Artificial Sequence
  Description of Artificial Sequence: Synthetic peptide
WVRQAPGKGLEWVS

SEQ ID NO: 2317 - protein, 14 aa, Artificial Sequence
  Description of Artificial Sequence: Synthetic peptide
WVRQAPGKGLEWVS

SEQ ID NO: 2318 - protein, 14 aa, Artificial Sequence
  Description of Artificial Sequence: Synthetic peptide
WVRQAPGKGLEWVS

SEQ ID NO: 2319 - protein, 17 aa, Artificial Sequence
  Description of Artificial Sequence: Synthetic peptide
SISSSGAYTHYADSVKG

SEQ ID NO: 2320 - protein, 17 aa, Artificial Sequence
  Description of Artificial Sequence: Synthetic peptide
SISPSGGDTHYADSVKG

SEQ ID NO: 2321 - protein, 17 aa, Artificial Sequence
  Description of Artificial Sequence: Synthetic peptide
SISSSGGSTEYADSVKG

SEQ ID NO: 2322 - protein, 17 aa, Artificial Sequence
  Description of Artificial Sequence: Synthetic peptide
SISPSGGSTWYADSVKG

SEQ ID NO: 2323 - protein, 17 aa, Artificial Sequence
  Description of Artificial Sequence: Synthetic peptide
SISPSGGNTRYADSVKG

SEQ ID NO: 2324 - protein, 17 aa, Artificial Sequence
  Description of Artificial Sequence: Synthetic peptide
GISSSGGQTMYADSVKG

SEQ ID NO: 2325 - protein, 17 aa, Artificial Sequence
  Description of Artificial Sequence: Synthetic peptide
VIYPSGGWTDYADSVKG

SEQ ID NO: 2326 - protein, 17 aa, Artificial Sequence
  Description of Artificial Sequence: Synthetic peptide
RIVPSGGDTMYADSVKG

SEQ ID NO: 2327 - protein, 17 aa, Artificial Sequence
  Description of Artificial Sequence: Synthetic peptide
SISSSGGMTYYADSVKG

SEQ ID NO: 2328 - protein, 17 aa, Artificial Sequence
  Description of Artificial Sequence: Synthetic peptide
SISPSGGWTRYADSVKG

SEQ ID NO: 2329 - protein, 17 aa, Artificial Sequence
  Description of Artificial Sequence: Synthetic peptide
SIGPSGGVTAYADSVKG

SEQ ID NO: 2330 - protein, 17 aa, Artificial Sequence
  Description of Artificial Sequence: Synthetic peptide
SISPSGGLTDYADSVKG

SEQ ID NO: 2331 - protein, 17 aa, Artificial Sequence
  Description of Artificial Sequence: Synthetic peptide
RIVSSGGTTHYADSVKG

SEQ ID NO: 2332 - protein, 17 aa, Artificial Sequence
  Description of Artificial Sequence: Synthetic peptide
GIVPSGGFTSYADSVKG

SEQ ID NO: 2333 - protein, 17 aa, Artificial Sequence
  Description of Artificial Sequence: Synthetic peptide
YISSSGGITMYADSVKG

SEQ ID NO: 2334 - protein, 17 aa, Artificial Sequence
  Description of Artificial Sequence: Synthetic peptide
GIGPSGGYTTYADSVKG

SEQ ID NO: 2335 - protein, 17 aa, Artificial Sequence
  Description of Artificial Sequence: Synthetic peptide
VIYPSGGPTLYADSVKG

SEQ ID NO: 2336 - protein, 17 aa, Artificial Sequence
  Description of Artificial Sequence: Synthetic peptide
RIYSSGGNTVYADSVKG

SEQ ID NO: 2337 - protein, 17 aa, Artificial Sequence
  Description of Artificial Sequence: Synthetic peptide
GIYPSGGYTLYADSVKG

SEQ ID NO: 2338 - protein, 17 aa, Artificial Sequence
  Description of Artificial Sequence: Synthetic peptide
SISPSGGWTRYADSVKG

SEQ ID NO: 2339 - protein, 17 aa, Artificial Sequence
  Description of Artificial Sequence: Synthetic peptide
GISSSGGLTFYADSVKG

SEQ ID NO: 2340 - protein, 17 aa, Artificial Sequence
  Description of Artificial Sequence: Synthetic peptide
SISSSGGYTHYADSVKG

SEQ ID NO: 2341 - protein, 17 aa, Artificial Sequence
  Description of Artificial Sequence: Synthetic peptide
GIYPSGGITTYADSVKG

SEQ ID NO: 2342 - protein, 17 aa, Artificial Sequence
  Description of Artificial Sequence: Synthetic peptide
YISSSGGLTTYADSVKG

SEQ ID NO: 2343 - protein, 17 aa, Artificial Sequence
  Description of Artificial Sequence: Synthetic peptide
VIYPSGGYTHYADSVKG

SEQ ID NO: 2344 - protein, 17 aa, Artificial Sequence
  Description of Artificial Sequence: Synthetic peptide
GISPSGGLTDYADSVKG

SEQ ID NO: 2345 - protein, 32 aa, Artificial Sequence; identical to SEQ ID NO: 952
  Description of Artificial Sequence: Synthetic polypeptide

SEQ ID NO: 2346 - protein, 32 aa, Artificial Sequence; identical to SEQ ID NO: 952
  Description of Artificial Sequence: Synthetic polypeptide

SEQ ID NO: 2347 - protein, 32 aa, Artificial Sequence
  Description of Artificial Sequence: Synthetic polypeptide
RFNISRDNSKNTLYLQMNSLRAEDTAMYYCAR

SEQ ID NO: 2348 - protein, 32 aa, Artificial Sequence; identical to SEQ ID NO: 952
  Description of Artificial Sequence: Synthetic polypeptide

SEQ ID NO: 2349 - protein, 32 aa, Artificial Sequence; identical to SEQ ID NO: 952
  Description of Artificial Sequence: Synthetic polypeptide

SEQ ID NO: 2350 - protein, 32 aa, Artificial Sequence; identical to SEQ ID NO: 952
  Description of Artificial Sequence: Synthetic polypeptide

SEQ ID NO: 2351 - protein, 32 aa, Artificial Sequence; identical to SEQ ID NO: 952
  Description of Artificial Sequence: Synthetic polypeptide

SEQ ID NO: 2352 - protein, 32 aa, Artificial Sequence; identical to SEQ ID NO: 952
  Description of Artificial Sequence: Synthetic polypeptide

SEQ ID NO: 2353 - protein, 32 aa, Artificial Sequence
  Description of Artificial Sequence: Synthetic polypeptide
RFTISRDNSKNTLYLQMNSLRAEDTAVYYCTT

SEQ ID NO: 2354 - protein, 32 aa, Artificial Sequence; identical to SEQ ID NO: 2353
  Description of Artificial Sequence: Synthetic polypeptide

SEQ ID NO: 2355 - protein, 32 aa, Artificial Sequence
  Description of Artificial Sequence: Synthetic polypeptide
RFTISRDNSKNTLYLQMNSLRAEDTAMYYCAR

SEQ ID NO: 2356 - protein, 32 aa, Artificial Sequence
  Description of Artificial Sequence: Synthetic polypeptide
RFTISRDNSKNTLYLQMNSLRAEDTATYYCAN

SEQ ID NO: 2357 - protein, 32 aa, Artificial Sequence; identical to SEQ ID NO: 2353
  Description of Artificial Sequence: Synthetic polypeptide

SEQ ID NO: 2358 - protein, 32 aa, Artificial Sequence
  Description of Artificial Sequence: Synthetic polypeptide
RFTISRDNSKNTLYLQMNSLRVEDTAVYYCAR

SEQ ID NO: 2359 - protein, 32 aa, Artificial Sequence
  Description of Artificial Sequence: Synthetic polypeptide
RFTISRDNSKNTLYLQMNSLRAEDTAVYYCAA

SEQ ID NO: 2360 - protein, 32 aa, Artificial Sequence
  Description of Artificial Sequence: Synthetic polypeptide
RFTISRDNFKNTLYLQMNSLRAEDTAVYYCAR

SEQ ID NO: 2361 - protein, 32 aa, Artificial Sequence; identical to SEQ ID NO: 952
  Description of Artificial Sequence: Synthetic polypeptide

SEQ ID NO: 2362 - protein, 32 aa, Artificial Sequence
  Description of Artificial Sequence: Synthetic polypeptide
RFTISRDNSKNTLYLQMNSLRAEDTATYYCAR

SEQ ID NO: 2363 - protein, 32 aa, Artificial Sequence; identical to SEQ ID NO: 952
  Description of Artificial Sequence: Synthetic polypeptide

SEQ ID NO: 2364 - protein, 32 aa, Artificial Sequence
  Description of Artificial Sequence: Synthetic polypeptide
RFTISRDNSKNTLYLQMNSLRAEDTAVYYCAS

SEQ ID NO: 2365 - protein, 32 aa, Artificial Sequence
  Description of Artificial Sequence: Synthetic polypeptide
RFTISRDNSNNTLYLQMNSLRAEDTAVYYCAR

SEQ ID NO: 2366 - protein, 32 aa, Artificial Sequence; identical to SEQ ID NO: 952
  Description of Artificial Sequence: Synthetic polypeptide

SEQ ID NO: 2367 - protein, 32 aa, Artificial Sequence; identical to SEQ ID NO: 952
  Description of Artificial Sequence: Synthetic polypeptide

SEQ ID NO: 2368 - protein, 32 aa, Artificial Sequence; identical to SEQ ID NO: 952
  Description of Artificial Sequence: Synthetic polypeptide

SEQ ID NO: 2369 - protein, 32 aa, Artificial Sequence; identical to SEQ ID NO: 2355
  Description of Artificial Sequence: Synthetic polypeptide

SEQ ID NO: 2370 - protein, 32 aa, Artificial Sequence
  Description of Artificial Sequence: Synthetic polypeptide
RFTISRDNSKNTLYLQMNSLRAEDTAVYYCAH

SEQ ID NO: 2371 - protein, 11 aa, Artificial Sequence
  Description of Artificial Sequence: Synthetic peptide
EGVDTAMAFGY

SEQ ID NO: 2372 - protein, 10 aa, Artificial Sequence
  Description of Artificial Sequence: Synthetic peptide
WEAKVDAFDI

SEQ ID NO: 2373 - protein, 10 aa, Artificial Sequence
  Description of Artificial Sequence: Synthetic peptide
HPDGVARFDP

SEQ ID NO: 2374 - protein, 14 aa, Artificial Sequence
  Description of Artificial Sequence: Synthetic peptide
RGWAAAGYYYGMDV

SEQ ID NO: 2375 - protein, 13 aa, Artificial Sequence
  Description of Artificial Sequence: Synthetic peptide
DGVSKWYYHGIDV

SEQ ID NO: 2376 - protein, 11 aa, Artificial Sequence
  Description of Artificial Sequence: Synthetic peptide
GVAYDSKTPDI

SEQ ID NO: 2377 - protein, 11 aa, Artificial Sequence
  Description of Artificial Sequence: Synthetic peptide
MAVTGGSRFDY

SEQ ID NO: 2378 - protein, 18 aa, Artificial Sequence
  Description of Artificial Sequence: Synthetic peptide
DLGDYDFWSGTLYYGMDV

SEQ ID NO: 2379 - protein, 11 aa, Artificial Sequence
  Description of Artificial Sequence: Synthetic peptide
ADYGYYYGMDV

SEQ ID NO: 2380 - protein, 13 aa, Artificial Sequence
  Description of Artificial Sequence: Synthetic peptide
APYPNWNYHYFDY

SEQ ID NO: 2381 - protein, 9 aa, Artificial Sequence
  Description of Artificial Sequence: Synthetic peptide
HSRDIAVDY

SEQ ID NO: 2382 - protein, 11 aa, Artificial Sequence
  Description of Artificial Sequence: Synthetic peptide
PWPLTAELADI

SEQ ID NO: 2383 - protein, 7 aa, Artificial Sequence
  Description of Artificial Sequence: Synthetic peptide
GDYSWDY

SEQ ID NO: 2384 - protein, 9 aa, Artificial Sequence
  Description of Artificial Sequence: Synthetic peptide
RGVVGGLDY

SEQ ID NO: 2385 - protein, 8 aa, Artificial Sequence
  Description of Artificial Sequence: Synthetic peptide
ENRVPFDY

SEQ ID NO: 2386 - protein, 10 aa, Artificial Sequence
  Description of Artificial Sequence: Synthetic peptide
HPVGYDAFDI

SEQ ID NO: 2387 - protein, 13 aa, Artificial Sequence
  Description of Artificial Sequence: Synthetic peptide
DGVLRGSHIYFDY

SEQ ID NO: 2388 - protein, 11 aa, Artificial Sequence
  Description of Artificial Sequence: Synthetic peptide
TRRDGYNPFDY

SEQ ID NO: 2389 - protein, 7 aa, Artificial Sequence
  Description of Artificial Sequence: Synthetic peptide
HGDYMDV

SEQ ID NO: 2390 - protein, 10 aa, Artificial Sequence
  Description of Artificial Sequence: Synthetic peptide
SPYGPDAFDI

SEQ ID NO: 2391 - protein, 13 aa, Artificial Sequence
  Description of Artificial Sequence: Synthetic peptide
VPAYSSGYGGFDY

SEQ ID NO: 2392 - protein, 11 aa, Artificial Sequence
  Description of Artificial Sequence: Synthetic peptide
EGVDTAMAFGY

SEQ ID NO: 2393 - protein, 17 aa, Artificial Sequence
  Description of Artificial Sequence: Synthetic peptide
VFFYYDSSGYYAPYFDY

SEQ ID NO: 2394 - protein, 18 aa, Artificial Sequence
  Description of Artificial Sequence: Synthetic peptide
SPTYYDFWSGYWAGIFDY

SEQ ID NO: 2395 - protein, 15 aa, Artificial Sequence
  Description of Artificial Sequence: Synthetic peptide
VGYDSSGYYWGYFDY

SEQ ID NO: 2396 - protein, 7 aa, Artificial Sequence
  Description of Artificial Sequence: Synthetic peptide
GTDPLTY

SEQ ID NO: 2397 - protein, 11 aa, Artificial Sequence
  Description of Artificial Sequence: Synthetic peptide
WGQGTLVTVSS

SEQ ID NO: 2398 - protein, 11 aa, Artificial Sequence
  Description of Artificial Sequence: Synthetic peptide
WGQGTTVTVSS

SEQ ID NO: 2399 - protein, 11 aa, Artificial Sequence
  Description of Artificial Sequence: Synthetic peptide
WGQGTLVTVSS

SEQ ID NO: 2400 - protein, 11 aa, Artificial Sequence
  Description of Artificial Sequence: Synthetic peptide
WGQGTTVTVSS

SEQ ID NO: 2401 - protein, 11 aa, Artificial Sequence
  Description of Artificial Sequence: Synthetic peptide
WGQGTTVTVSS

SEQ ID NO: 2402 - protein, 11 aa, Artificial Sequence
  Description of Artificial Sequence: Synthetic peptide
WGRGTMVTVSS

SEQ ID NO: 2403 - protein, 11 aa, Artificial Sequence
  Description of Artificial Sequence: Synthetic peptide
WGQGTLVTVSS

SEQ ID NO: 2404 - protein, 11 aa, Artificial Sequence
  Description of Artificial Sequence: Synthetic peptide
WGQGTTVTVSS

SEQ ID NO: 2405 - protein, 11 aa, Artificial Sequence
  Description of Artificial Sequence: Synthetic peptide
WGQGTTVTVSS

SEQ ID NO: 2406 - protein, 11 aa, Artificial Sequence
  Description of Artificial Sequence: Synthetic peptide
WGQGTLVTVSS

SEQ ID NO: 2407 - protein, 11 aa, Artificial Sequence
  Description of Artificial Sequence: Synthetic peptide
WGQGTLVTVSS

SEQ ID NO: 2408 - protein, 11 aa, Artificial Sequence
  Description of Artificial Sequence: Synthetic peptide
WGQGTMVTVSS

SEQ ID NO: 2409 - protein, 11 aa, Artificial Sequence
  Description of Artificial Sequence: Synthetic peptide
WGQGTLVTVSS

SEQ ID NO: 2410 - protein, 11 aa, Artificial Sequence
  Description of Artificial Sequence: Synthetic peptide
WGQGTLVTVSS

SEQ ID NO: 2411 - protein, 11 aa, Artificial Sequence
  Description of Artificial Sequence: Synthetic peptide
WGQGTLVTVSS

SEQ ID NO: 2412 - protein, 11 aa, Artificial Sequence
  Description of Artificial Sequence: Synthetic peptide
WGQGTMVTVSS

SEQ ID NO: 2413 - protein, 11 aa, Artificial Sequence
  Description of Artificial Sequence: Synthetic peptide
WGQGTLVTVSS

SEQ ID NO: 2414 - protein, 11 aa, Artificial Sequence
  Description of Artificial Sequence: Synthetic peptide
WGQGTLVTVSS

SEQ ID NO: 2415 - protein, 11 aa, Artificial Sequence
  Description of Artificial Sequence: Synthetic peptide
WGKGTTVTVSS

SEQ ID NO: 2416 - protein, 11 aa, Artificial Sequence
  Description of Artificial Sequence: Synthetic peptide
WGQGTMVTVSS

SEQ ID NO: 2417 - protein, 11 aa, Artificial Sequence
  Description of Artificial Sequence: Synthetic peptide
WGQGTLVTVSS

SEQ ID NO: 2418 - protein, 11 aa, Artificial Sequence
  Description of Artificial Sequence: Synthetic peptide
WGQGTLVTVSS

SEQ ID NO: 2419 - protein, 11 aa, Artificial Sequence
  Description of Artificial Sequence: Synthetic peptide
WGQGTLVTVSS

SEQ ID NO: 2420 - protein, 11 aa, Artificial Sequence
  Description of Artificial Sequence: Synthetic peptide
WGQGTLVTVSS

SEQ ID NO: 2421 - protein, 11 aa, Artificial Sequence
  Description of Artificial Sequence: Synthetic peptide
WGQGTLVTVSS

SEQ ID NO: 2422 - protein, 11 aa, Artificial Sequence
  Description of Artificial Sequence: Synthetic peptide
WGQGTLVTVSS

SEQ ID NO: 2423 - protein, 24 aa, Artificial Sequence
  Description of Artificial Sequence: Synthetic peptide
QDIQMTQSPSSLSASVGDRVSITC

SEQ ID NO: 2424 - protein, 24 aa, Artificial Sequence
  Description of Artificial Sequence: Synthetic peptide
QNIQMTQSPSSVSASVGDRVTITC

SEQ ID NO: 2425 - protein, 24 aa, Artificial Sequence
  Description of Artificial Sequence: Synthetic peptide
QDIQMTQSPSSLSASVGDRVSITC

SEQ ID NO: 2426 - protein, 24 aa, Artificial Sequence
  Description of Artificial Sequence: Synthetic peptide
QDIQMTQSPSSLSASVGDRVTITC

SEQ ID NO: 2427 - protein, 24 aa, Artificial Sequence
  Description of Artificial Sequence: Synthetic peptide
QDIQMTQSPDTLSLSPGERATLSC

SEQ ID NO: 2428 - protein, 24 aa, Artificial Sequence
  Description of Artificial Sequence: Synthetic peptide
QDIQMTQSPGTLSLSPGERATLSC

SEQ ID NO: 2429 - protein, 24 aa, Artificial Sequence
  Description of Artificial Sequence: Synthetic peptide
QDIQMTQSPGTLSLSSGERATLSC

SEQ ID NO: 2430 - protein, 24 aa, Artificial Sequence
  Description of Artificial Sequence: Synthetic peptide
QDIQMTQSPSSLSASVGDRVTITC

SEQ ID NO: 2431 - protein, 22 aa, Artificial Sequence
  Description of Artificial Sequence: Synthetic peptide
QYELTQPPALSVAPGETATITC

SEQ ID NO: 2432 - protein, 22 aa, Artificial Sequence
  Description of Artificial Sequence: Synthetic peptide
QSALTQPPSVSVAPGQTARITC

SEQ ID NO: 2433 - protein, 24 aa, Artificial Sequence
  Description of Artificial Sequence: Synthetic peptide
QDIQMTQSPGTLSLSPGERATLSC

SEQ ID NO: 2434 - protein, 22 aa, Artificial Sequence
  Description of Artificial Sequence: Synthetic peptide
QSELTQPPSVSVSPGQTATITC

SEQ ID NO: 2435 - protein, 11 aa, Artificial Sequence
  Description of Artificial Sequence: Synthetic peptide
RASQNINSYLN

SEQ ID NO: 2436 - protein, 11 aa, Artificial Sequence
  Description of Artificial Sequence: Synthetic peptide
RASQDINYWLA

SEQ ID NO: 2437 - protein, 11 aa, Artificial Sequence
  Description of Artificial Sequence: Synthetic peptide
RASQNINSYLN

SEQ ID NO: 2438 - protein, 11 aa, Artificial Sequence
  Description of Artificial Sequence: Synthetic peptide
RASQSISYFLN

SEQ ID NO: 2439 - protein, 12 aa, Artificial Sequence
  Description of Artificial Sequence: Synthetic peptide
RASQTISSTFLA

SEQ ID NO: 2440 - protein, 12 aa, Artificial Sequence
  Description of Artificial Sequence: Synthetic peptide
RASQSVSSSYLA

SEQ ID NO: 2441 - protein, 12 aa, Artificial Sequence
  Description of Artificial Sequence: Synthetic peptide
RASQSVSSNYLA

SEQ ID NO: 2442 - protein, 11 aa, Artificial Sequence
  Description of Artificial Sequence: Synthetic peptide
RANQSIYTYLN

SEQ ID NO: 2443 - protein, 11 aa, Artificial Sequence
  Description of Artificial Sequence: Synthetic peptide
GGDKIGRKSVN

SEQ ID NO: 2444 - protein, 11 aa, Artificial Sequence
  Description of Artificial Sequence: Synthetic peptide
GGNNIGTKSVH

SEQ ID NO: 2445 - protein, 12 aa, Artificial Sequence
  Description of Artificial Sequence: Synthetic peptide
RASQSVSSSYLA

SEQ ID NO: 2446 - protein, 11 aa, Artificial Sequence
  Description of Artificial Sequence: Synthetic peptide
SGDVSVHKSFC

SEQ ID NO: 2447 - protein, 15 aa, Artificial Sequence
  Description of Artificial Sequence: Synthetic peptide
WYQQKVGKAPKLLIF

SEQ ID NO: 2448 - protein, 15 aa, Artificial Sequence
  Description of Artificial Sequence: Synthetic peptide
WYQQKPGKAPKLLIY

SEQ ID NO: 2449 - protein, 15 aa, Artificial Sequence
  Description of Artificial Sequence: Synthetic peptide
WYQQKVGKAPKLLIF

SEQ ID NO: 2450 - protein, 15 aa, Artificial Sequence
  Description of Artificial Sequence: Synthetic peptide
WYQQKPGKAPKLLIY

SEQ ID NO: 2451 - protein, 15 aa, Artificial Sequence
  Description of Artificial Sequence: Synthetic peptide
WYQQKPGQAPRLLIY

SEQ ID NO: 2452 - protein, 15 aa, Artificial Sequence
  Description of Artificial Sequence: Synthetic peptide
WYQQKPGQAPRLLIY

SEQ ID NO: 2453 - protein, 15 aa, Artificial Sequence
  Description of Artificial Sequence: Synthetic peptide
WYQQKRGQAPRLLIY

SEQ ID NO: 2454 - protein, 15 aa, Artificial Sequence
  Description of Artificial Sequence: Synthetic peptide
WYQQKPGKAPELLIY

SEQ ID NO: 2455 - protein, 15 aa, Artificial Sequence
  Description of Artificial Sequence: Synthetic peptide
WYQQKAGQAPVLVIF

SEQ ID NO: 2456 - protein, 15 aa, Artificial Sequence
  Description of Artificial Sequence: Synthetic peptide
WYQQKSGQAPVLVVY

SEQ ID NO: 2457 - protein, 15 aa, Artificial Sequence
  Description of Artificial Sequence: Synthetic peptide
WYQQKPGQAPRLLIY

SEQ ID NO: 2458 - protein, 15 aa, Artificial Sequence
  Description of Artificial Sequence: Synthetic peptide
WYQQRPGQSPVLVIY

SEQ ID NO: 2459 - protein, 7 aa, Artificial Sequence
  Description of Artificial Sequence: Synthetic peptide
GAYTLHS

SEQ ID NO: 2460 - protein, 7 aa, Artificial Sequence
  Description of Artificial Sequence: Synthetic peptide
AASSLQS

SEQ ID NO: 2461 - protein, 7 aa, Artificial Sequence
  Description of Artificial Sequence: Synthetic peptide
GAYTLHS

SEQ ID NO: 2462 - protein, 7 aa, Artificial Sequence
  Description of Artificial Sequence: Synthetic peptide
AASTLQG

SEQ ID NO: 2463 - protein, 7 aa, Artificial Sequence
  Description of Artificial Sequence: Synthetic peptide
GASTRAA

SEQ ID NO: 2464 - protein, 7 aa, Artificial Sequence
  Description of Artificial Sequence: Synthetic peptide
GASSRAT

SEQ ID NO: 2465 - protein, 7 aa, Artificial Sequence
  Description of Artificial Sequence: Synthetic peptide
GASSRAT

SEQ ID NO: 2466 - protein, 7 aa, Artificial Sequence
  Description of Artificial Sequence: Synthetic peptide
AASSLQS

SEQ ID NO: 2467 - protein, 7 aa, Artificial Sequence
  Description of Artificial Sequence: Synthetic peptide
YDNDRPS

SEQ ID NO: 2468 - protein, 7 aa, Artificial Sequence
  Description of Artificial Sequence: Synthetic peptide
DNSDRPS

SEQ ID NO: 2469 - protein, 7 aa, Artificial Sequence
  Description of Artificial Sequence: Synthetic peptide
GASSRAT

SEQ ID NO: 2470 - protein, 7 aa, Artificial Sequence
  Description of Artificial Sequence: Synthetic peptide
QIDKRPS

SEQ ID NO: 2471 - protein, 32 aa, Artificial Sequence; identical to SEQ ID NO: 2143
  Description of Artificial Sequence: Synthetic polypeptide

SEQ ID NO: 2472 - protein, 32 aa, Artificial Sequence; identical to SEQ ID NO: 186
  Description of Artificial Sequence: Synthetic polypeptide

SEQ ID NO: 2473 - protein, 32 aa, Artificial Sequence; identical to SEQ ID NO: 2143
  Description of Artificial Sequence: Synthetic polypeptide

SEQ ID NO: 2474 - protein, 32 aa, Artificial Sequence; identical to SEQ ID NO: 2160
  Description of Artificial Sequence: Synthetic polypeptide

SEQ ID NO: 2475 - protein, 32 aa, Artificial Sequence
  Description of Artificial Sequence: Synthetic polypeptide
GIPDRFIGSGSGTDFTLTISSLEPEDSAVYYC

SEQ ID NO: 2476 - protein, 32 aa, Artificial Sequence; identical to SEQ ID NO: 218
  Description of Artificial Sequence: Synthetic polypeptide

SEQ ID NO: 2477 - protein, 32 aa, Artificial Sequence; identical to SEQ ID NO: 2145
  Description of Artificial Sequence: Synthetic polypeptide

SEQ ID NO: 2478 - protein, 32 aa, Artificial Sequence; identical to SEQ ID NO: 186
  Description of Artificial Sequence: Synthetic polypeptide

SEQ ID NO: 2479 - protein, 32 aa, Artificial Sequence
  Description of Artificial Sequence: Synthetic polypeptide
GITGRFSGSNSGNSATLTISRVEAGDEADFYC

SEQ ID NO: 2480 - protein, 32 aa, Artificial Sequence
  Description of Artificial Sequence: Synthetic polypeptide
GIPERFSGSNSGNTATLTISRVEAGDEADYYC

SEQ ID NO: 2481 - protein, 32 aa, Artificial Sequence; identical to SEQ ID NO: 218
  Description of Artificial Sequence: Synthetic polypeptide

SEQ ID NO: 2482 - protein, 32 aa, Artificial Sequence
  Description of Artificial Sequence: Synthetic polypeptide
GVPERFSGSISGTTATLTISGTQATDEADYYC

SEQ ID NO: 2483 - protein, 8 aa, Artificial Sequence
  Description of Artificial Sequence: Synthetic peptide
QQTYTSYS

SEQ ID NO: 2484 - protein, 9 aa, Artificial Sequence
  Description of Artificial Sequence: Synthetic peptide
QRANSFPYT

SEQ ID NO: 2485 - protein, 8 aa, Artificial Sequence
  Description of Artificial Sequence: Synthetic peptide
QQTYTSYS

SEQ ID NO: 2486 - protein, 10 aa, Artificial Sequence
  Description of Artificial Sequence: Synthetic peptide
QHSYSTPPIT

SEQ ID NO: 2487 - protein, 8 aa, Artificial Sequence
  Description of Artificial Sequence: Synthetic peptide
QQYDRSPT

SEQ ID NO: 2488 - protein, 9 aa, Artificial Sequence
  Description of Artificial Sequence: Synthetic peptide
QQYGSSPRT

SEQ ID NO: 2489 - protein, 9 aa, Artificial Sequence
  Description of Artificial Sequence: Synthetic peptide
QQYGSSPRT

SEQ ID NO: 2490 - protein, 5 aa, Artificial Sequence
  Description of Artificial Sequence: Synthetic peptide
QQAGI

SEQ ID NO: 2491 - protein, 10 aa, Artificial Sequence
  Description of Artificial Sequence: Synthetic peptide
QVWGPNDFPL

SEQ ID NO: 2492 - protein, 11 aa, Artificial Sequence
  Description of Artificial Sequence: Synthetic peptide
QVWDNSIDHVV

SEQ ID NO: 2493 - protein, 10 aa, Artificial Sequence
  Description of Artificial Sequence: Synthetic peptide
QQYGSSPPIT

SEQ ID NO: 2494 - protein, 10 aa, Artificial Sequence
  Description of Artificial Sequence: Synthetic peptide
QGWDSTTYYV

SEQ ID NO: 2495 - protein, 10 aa, Artificial Sequence
  Description of Artificial Sequence: Synthetic peptide
FAQGTKLEIK

SEQ ID NO: 2496 - protein, 10 aa, Artificial Sequence
  Description of Artificial Sequence: Synthetic peptide
FGQGTKLEIK

SEQ ID NO: 2497 - protein, 10 aa, Artificial Sequence
  Description of Artificial Sequence: Synthetic peptide
FAQGTKLEIK

SEQ ID NO: 2498 - protein, 10 aa, Artificial Sequence
  Description of Artificial Sequence: Synthetic peptide
FGPGTKVDIK

SEQ ID NO: 2499 - protein, 10 aa, Artificial Sequence
  Description of Artificial Sequence: Synthetic peptide
FGGGTKVEIK

SEQ ID NO: 2500 - protein, 10 aa, Artificial Sequence
  Description of Artificial Sequence: Synthetic peptide
FGQGTKLEIK

SEQ ID NO: 2501 - protein, 10 aa, Artificial Sequence
  Description of Artificial Sequence: Synthetic peptide
FGQGTKLEIK

SEQ ID NO: 2502 - protein, 10 aa, Artificial Sequence
  Description of Artificial Sequence: Synthetic peptide
FGQGTKLEIK

SEQ ID NO: 2503 - protein, 10 aa, Artificial Sequence
  Description of Artificial Sequence: Synthetic peptide
FGGGTKLTVL

SEQ ID NO: 2504 - protein, 10 aa, Artificial Sequence
  Description of Artificial Sequence: Synthetic peptide
FGGGTKLTVL

SEQ ID NO: 2505 - protein, 10 aa, Artificial Sequence
  Description of Artificial Sequence: Synthetic peptide
FGQGTRLEIK

SEQ ID NO: 2506 - protein, 10 aa, Artificial Sequence
  Description of Artificial Sequence: Synthetic peptide
FGTGTKVTVL

SEQ ID NO: 2507 - protein, 7 aa, Artificial Sequence
  Description of Artificial Sequence: Synthetic peptide
AAPSVFI

SEQ ID NO: 2508 - protein, 7 aa, Artificial Sequence
  Description of Artificial Sequence: Synthetic peptide
RTVAAPS

SEQ ID NO: 2509 - protein, 7 aa, Artificial Sequence
  Description of Artificial Sequence: Synthetic peptide
AAPSVFI

SEQ ID NO: 2510 - protein, 7 aa, Artificial Sequence
  Description of Artificial Sequence: Synthetic peptide
RTVAAPS

SEQ ID NO: 2511 - protein, 7 aa, Artificial Sequence
  Description of Artificial Sequence: Synthetic peptide
RTVAAPS

SEQ ID NO: 2512 - protein, 7 aa, Artificial Sequence
  Description of Artificial Sequence: Synthetic peptide
RTVAAPS

SEQ ID NO: 2513 - protein, 7 aa, Artificial Sequence
  Description of Artificial Sequence: Synthetic peptide
RTVAAPS

SEQ ID NO: 2514 - protein, 7 aa, Artificial Sequence
  Description of Artificial Sequence: Synthetic peptide
RTVAAPS

SEQ ID NO: 2515 - protein, 7 aa, Artificial Sequence
  Description of Artificial Sequence: Synthetic peptide
GQPKAAP

SEQ ID NO: 2516 - protein, 7 aa, Artificial Sequence
  Description of Artificial Sequence: Synthetic peptide
GQPKAAP

SEQ ID NO: 2517 - protein, 7 aa, Artificial Sequence
  Description of Artificial Sequence: Synthetic peptide
RTVAAPS

SEQ ID NO: 2518 - protein, 7 aa, Artificial Sequence
  Description of Artificial Sequence: Synthetic peptide
SQPKANP

SEQ ID NO: 2519 - protein, 30 aa, Artificial Sequence; identical to SEQ ID NO: 322
  Description of Artificial Sequence: Synthetic polypeptide

SEQ ID NO: 2520 - protein, 30 aa, Artificial Sequence; identical to SEQ ID NO: 322
  Description of Artificial Sequence: Synthetic polypeptide

SEQ ID NO: 2521 - protein, 30 aa, Artificial Sequence; identical to SEQ ID NO: 322
  Description of Artificial Sequence: Synthetic polypeptide

SEQ ID NO: 2522 - protein, 30 aa, Artificial Sequence; identical to SEQ ID NO: 322
  Description of Artificial Sequence: Synthetic polypeptide

SEQ ID NO: 2523 - protein, 30 aa, Artificial Sequence; identical to SEQ ID NO: 322
  Description of Artificial Sequence: Synthetic polypeptide

SEQ ID NO: 2524 - protein, 30 aa, Artificial Sequence; identical to SEQ ID NO: 322
  Description of Artificial Sequence: Synthetic polypeptide

SEQ ID NO: 2525 - protein, 30 aa, Artificial Sequence; identical to SEQ ID NO: 322
  Description of Artificial Sequence: Synthetic polypeptide

SEQ ID NO: 2526 - protein, 30 aa, Artificial Sequence; identical to SEQ ID NO: 322
  Description of Artificial Sequence: Synthetic polypeptide

SEQ ID NO: 2527 - protein, 30 aa, Artificial Sequence; identical to SEQ ID NO: 322
  Description of Artificial Sequence: Synthetic polypeptide

SEQ ID NO: 2528 - protein, 30 aa, Artificial Sequence; identical to SEQ ID NO: 322
  Description of Artificial Sequence: Synthetic polypeptide

SEQ ID NO: 2529 - protein, 30 aa, Artificial Sequence; identical to SEQ ID NO: 322
  Description of Artificial Sequence: Synthetic polypeptide

SEQ ID NO: 2530 - protein, 30 aa, Artificial Sequence; identical to SEQ ID NO: 322
  Description of Artificial Sequence: Synthetic polypeptide

SEQ ID NO: 2531 - protein, 30 aa, Artificial Sequence; identical to SEQ ID NO: 322
  Description of Artificial Sequence: Synthetic polypeptide

SEQ ID NO: 2532 - protein, 5 aa, Artificial Sequence
  Description of Artificial Sequence: Synthetic peptide
DYNMH

SEQ ID NO: 2533 - protein, 5 aa, Artificial Sequence
  Description of Artificial Sequence: Synthetic peptide
EYPMY

SEQ ID NO: 2534 - protein, 5 aa, Artificial Sequence
  Description of Artificial Sequence: Synthetic peptide
RYWMD

SEQ ID NO: 2535 - protein, 5 aa, Artificial Sequence
  Description of Artificial Sequence: Synthetic peptide
EYPMY

SEQ ID NO: 2536 - protein, 5 aa, Artificial Sequence
  Description of Artificial Sequence: Synthetic peptide
YYPMA

SEQ ID NO: 2537 - protein, 5 aa, Artificial Sequence
  Description of Artificial Sequence: Synthetic peptide
FYHME

SEQ ID NO: 2538 - protein, 5 aa, Artificial Sequence
  Description of Artificial Sequence: Synthetic peptide
SYGMH

SEQ ID NO: 2539 - protein, 5 aa, Artificial Sequence
  Description of Artificial Sequence: Synthetic peptide
HYWMH

SEQ ID NO: 2540 - protein, 5 aa, Artificial Sequence
  Description of Artificial Sequence: Synthetic peptide
DYNMH

SEQ ID NO: 2541 - protein, 5 aa, Artificial Sequence
  Description of Artificial Sequence: Synthetic peptide
MYWMF

SEQ ID NO: 2542 - protein, 5 aa, Artificial Sequence
  Description of Artificial Sequence: Synthetic peptide
WYNMW

SEQ ID NO: 2543 - protein, 5 aa, Artificial Sequence
  Description of Artificial Sequence: Synthetic peptide
RYGMT

SEQ ID NO: 2544 - protein, 5 aa, Artificial Sequence
  Description of Artificial Sequence: Synthetic peptide
EYNMP

SEQ ID NO: 2545 - protein, 14 aa, Artificial Sequence
  Description of Artificial Sequence: Synthetic peptide
WVRQAPGKGLEWVS

SEQ ID NO: 2546 - protein, 14 aa, Artificial Sequence
  Description of Artificial Sequence: Synthetic peptide
WVRQAPGKGLEWVS

SEQ ID NO: 2547 - protein, 14 aa, Artificial Sequence
  Description of Artificial Sequence: Synthetic peptide
WVRQAPGKGLEWVS

SEQ ID NO: 2548 - protein, 14 aa, Artificial Sequence
  Description of Artificial Sequence: Synthetic peptide
WVRQAPGKGLEWVS

SEQ ID NO: 2549 - protein, 14 aa, Artificial Sequence
  Description of Artificial Sequence: Synthetic peptide
WVRQAPGKGLEWVS

SEQ ID NO: 2550 - protein, 14 aa, Artificial Sequence
  Description of Artificial Sequence: Synthetic peptide
WVRQAPGKGLEWVS

SEQ ID NO: 2551 - protein, 14 aa, Artificial Sequence
  Description of Artificial Sequence: Synthetic peptide
WVRQAPGKGLEWVS

SEQ ID NO: 2552 - protein, 14 aa, Artificial Sequence
  Description of Artificial Sequence: Synthetic peptide
WVRQAPGKGLEWVS

SEQ ID NO: 2553 - protein, 14 aa, Artificial Sequence
  Description of Artificial Sequence: Synthetic peptide
WVRQAPGKGLEWVS

SEQ ID NO: 2554 - protein, 14 aa, Artificial Sequence
  Description of Artificial Sequence: Synthetic peptide
WVRQAPGKGLEWVS

SEQ ID NO: 2555 - protein, 14 aa, Artificial Sequence
  Description of Artificial Sequence: Synthetic peptide
WVRQAPGKGLEWVS

SEQ ID NO: 2556 - protein, 14 aa, Artificial Sequence
  Description of Artificial Sequence: Synthetic peptide
WVRQAPGKGLEWVS

SEQ ID NO: 2557 - protein, 14 aa, Artificial Sequence
  Description of Artificial Sequence: Synthetic peptide
WVRQAPGKGLEWVS

SEQ ID NO: 2558 - protein, 17 aa, Artificial Sequence
  Description of Artificial Sequence: Synthetic peptide
YIGPSGGYTHYADSVKG

SEQ ID NO: 2559 - protein, 17 aa, Artificial Sequence
  Description of Artificial Sequence: Synthetic peptide
VIYPSGGWTDYADSVKG

SEQ ID NO: 2560 - protein, 17 aa, Artificial Sequence
  Description of Artificial Sequence: Synthetic peptide
GIYPSGGYTLYADSVKG

SEQ ID NO: 2561 - protein, 17 aa, Artificial Sequence
  Description of Artificial Sequence: Synthetic peptide
VIYPSGGWTDYADSVKG

SEQ ID NO: 2562 - protein, 17 aa, Artificial Sequence
  Description of Artificial Sequence: Synthetic peptide
YISSSGGLTTYADSVKG

SEQ ID NO: 2563 - protein, 17 aa, Artificial Sequence
  Description of Artificial Sequence: Synthetic peptide
SISPSGGHTDYADSVKG

SEQ ID NO: 2564 - protein, 17 aa, Artificial Sequence
  Description of Artificial Sequence: Synthetic peptide
GIVSSGGSTIYADSVKG

SEQ ID NO: 2565 - protein, 17 aa, Artificial Sequence
  Description of Artificial Sequence: Synthetic peptide
SISSSGGMTYYADSVKG

SEQ ID NO: 2566 - protein, 17 aa, Artificial Sequence
  Description of Artificial Sequence: Synthetic peptide
YIGPSGGYTHYADSVKG

SEQ ID NO: 2567 - protein, 17 aa, Artificial Sequence
  Description of Artificial Sequence: Synthetic peptide
SISSSGGHTFYADSVKG

SEQ ID NO: 2568 - protein, 17 aa, Artificial Sequence
  Description of Artificial Sequence: Synthetic peptide
YIYPSGGNTGYADSVKG

SEQ ID NO: 2569 - protein, 17 aa, Artificial Sequence
  Description of Artificial Sequence: Synthetic peptide
GISPSGGNTWYADSVKG

SEQ ID NO: 2570 - protein, 17 aa, Artificial Sequence
  Description of Artificial Sequence: Synthetic peptide
YIYSSGGSTEYADSVKG

SEQ ID NO: 2571 - protein, 32 aa, Artificial Sequence; identical to SEQ ID NO: 458
  Description of Artificial Sequence: Synthetic polypeptide

SEQ ID NO: 2572 - protein, 32 aa, Artificial Sequence; identical to SEQ ID NO: 952
  Description of Artificial Sequence: Synthetic polypeptide

SEQ ID NO: 2573 - protein, 32 aa, Artificial Sequence; identical to SEQ ID NO: 952
  Description of Artificial Sequence: Synthetic polypeptide

SEQ ID NO: 2574 - protein, 32 aa, Artificial Sequence; identical to SEQ ID NO: 952
  Description of Artificial Sequence: Synthetic polypeptide

SEQ ID NO: 2575 - protein, 32 aa, Artificial Sequence; identical to SEQ ID NO: 952
  Description of Artificial Sequence: Synthetic polypeptide

SEQ ID NO: 2576 - protein, 32 aa, Artificial Sequence; identical to SEQ ID NO: 2364
  Description of Artificial Sequence: Synthetic polypeptide

SEQ ID NO: 2577 - protein, 32 aa, Artificial Sequence; identical to SEQ ID NO: 2353
  Description of Artificial Sequence: Synthetic polypeptide

SEQ ID NO: 2578 - protein, 32 aa, Artificial Sequence; identical to SEQ ID NO: 2353
  Description of Artificial Sequence: Synthetic polypeptide

SEQ ID NO: 2579 - protein, 32 aa, Artificial Sequence; identical to SEQ ID NO: 458
  Description of Artificial Sequence: Synthetic polypeptide

SEQ ID NO: 2580 - protein, 32 aa, Artificial Sequence; identical to SEQ ID NO: 952
  Description of Artificial Sequence: Synthetic polypeptide

SEQ ID NO: 2581 - protein, 32 aa, Artificial Sequence
  Description of Artificial Sequence: Synthetic polypeptide
RFTISRDNSKNTLYLQMNSLRAEDTAVYYCAV

SEQ ID NO: 2582 - protein, 32 aa, Artificial Sequence
  Description of Artificial Sequence: Synthetic polypeptide
RFTISRDNSKNTLYLQMNSLRAEDTAVYYCTS

SEQ ID NO: 2583 - protein, 32 aa, Artificial Sequence
  Description of Artificial Sequence: Synthetic polypeptide
RFTISRDNSKNTLYLQMNSLRAEDMAVYYCAK

SEQ ID NO: 2584 - protein, 13 aa, Artificial Sequence
  Description of Artificial Sequence: Synthetic peptide
DIRGAYSSGLFDY

SEQ ID NO: 2585 - protein, 11 aa, Artificial Sequence
  Description of Artificial Sequence: Synthetic peptide
MAVTGGSRFDY

SEQ ID NO: 2586 - protein, 7 aa, Artificial Sequence
  Description of Artificial Sequence: Synthetic peptide
HGDYMDV

SEQ ID NO: 2587 - protein, 11 aa, Artificial Sequence
  Description of Artificial Sequence: Synthetic peptide
MAVTGGSRFDY

SEQ ID NO: 2588 - protein, 18 aa, Artificial Sequence
  Description of Artificial Sequence: Synthetic peptide
SPTYYDFWSGYWAGIFDY

SEQ ID NO: 2589 - protein, 5 aa, Artificial Sequence
  Description of Artificial Sequence: Synthetic peptide
LLSGT

SEQ ID NO: 2590 - protein, 11 aa, Artificial Sequence
  Description of Artificial Sequence: Synthetic peptide
YDYGDHYGMDV

SEQ ID NO: 2591 - protein, 11 aa, Artificial Sequence
  Description of Artificial Sequence: Synthetic peptide
ADYGYYYGMDV

SEQ ID NO: 2592 - protein, 13 aa, Artificial Sequence
  Description of Artificial Sequence: Synthetic peptide
DIRGAYSSGLFDY

SEQ ID NO: 2593 - protein, 11 aa, Artificial Sequence
  Description of Artificial Sequence: Synthetic peptide
GSYSGYDPFDY

SEQ ID NO: 2594 - protein, 11 aa, Artificial Sequence
  Description of Artificial Sequence: Synthetic peptide
FEYSSSGPQGY

SEQ ID NO: 2595 - protein, 11 aa, Artificial Sequence
  Description of Artificial Sequence: Synthetic peptide
HDYGDHYGMDV

SEQ ID NO: 2596 - protein, 15 aa, Artificial Sequence
  Description of Artificial Sequence: Synthetic peptide
DLWEDSSTWGYGMDV

SEQ ID NO: 2597 - protein, 11 aa, Artificial Sequence
  Description of Artificial Sequence: Synthetic peptide
WGRGTLVTVSS

SEQ ID NO: 2598 - protein, 11 aa, Artificial Sequence
  Description of Artificial Sequence: Synthetic peptide
WGQGTLVTVSS

SEQ ID NO: 2599 - protein, 11 aa, Artificial Sequence
  Description of Artificial Sequence: Synthetic peptide
WGKGTTVTVSS

SEQ ID NO: 2600 - protein, 11 aa, Artificial Sequence
  Description of Artificial Sequence: Synthetic peptide
WGQGTLVTVSS

SEQ ID NO: 2601 - protein, 11 aa, Artificial Sequence
  Description of Artificial Sequence: Synthetic peptide
WGQGTLVTVSS

SEQ ID NO: 2602 - protein, 11 aa, Artificial Sequence
  Description of Artificial Sequence: Synthetic peptide
WGQGTLVTVSS

SEQ ID NO: 2603 - protein, 11 aa, Artificial Sequence
  Description of Artificial Sequence: Synthetic peptide
WGQGTTVTVSS

SEQ ID NO: 2604 - protein, 11 aa, Artificial Sequence
  Description of Artificial Sequence: Synthetic peptide
WGQGTTVTVSS

SEQ ID NO: 2605 - protein, 11 aa, Artificial Sequence
  Description of Artificial Sequence: Synthetic peptide
WGRGTLVTVSS

SEQ ID NO: 2606 - protein, 11 aa, Artificial Sequence
  Description of Artificial Sequence: Synthetic peptide
WGRGTLVTVSS

SEQ ID NO: 2607 - protein, 11 aa, Artificial Sequence
  Description of Artificial Sequence: Synthetic peptide
WGQGTLVTVSS

SEQ ID NO: 2608 - protein, 11 aa, Artificial Sequence
  Description of Artificial Sequence: Synthetic peptide
WGQGTLVTVSS

SEQ ID NO: 2609 - protein, 11 aa, Artificial Sequence
  Description of Artificial Sequence: Synthetic peptide
WGQGTTVTVSS

SEQ ID NO: 2610 - protein, 11 aa, Artificial Sequence
  Description of Artificial Sequence: Synthetic peptide
WGRGTLVTVSS

SEQ ID NO: 2611 - protein, 11 aa, Artificial Sequence
  Description of Artificial Sequence: Synthetic peptide
WGQGTLVTVSS

SEQ ID NO: 2612 - protein, 11 aa, Artificial Sequence
  Description of Artificial Sequence: Synthetic peptide
WGKGTTVTVSS

SEQ ID NO: 2613 - protein, 11 aa, Artificial Sequence
  Description of Artificial Sequence: Synthetic peptide
WGQGTLVTVSS

SEQ ID NO: 2614 - protein, 11 aa, Artificial Sequence
  Description of Artificial Sequence: Synthetic peptide
WGQGTLVTVSS

SEQ ID NO: 2615 - protein, 11 aa, Artificial Sequence
  Description of Artificial Sequence: Synthetic peptide
WGQGTLVTVSS

SEQ ID NO: 2616 - protein, 11 aa, Artificial Sequence
  Description of Artificial Sequence: Synthetic peptide
WGQGTTVTVSS

SEQ ID NO: 2617 - protein, 11 aa, Artificial Sequence
  Description of Artificial Sequence: Synthetic peptide
WGQGTTVTVSS

SEQ ID NO: 2618 - protein, 11 aa, Artificial Sequence
  Description of Artificial Sequence: Synthetic peptide
WGRGTLVTVSS

SEQ ID NO: 2619 - protein, 11 aa, Artificial Sequence
  Description of Artificial Sequence: Synthetic peptide
WGRGTLVTVSS

SEQ ID NO: 2620 - protein, 11 aa, Artificial Sequence
  Description of Artificial Sequence: Synthetic peptide
WGQGTLVTVSS

SEQ ID NO: 2621 - protein, 11 aa, Artificial Sequence
  Description of Artificial Sequence: Synthetic peptide
WGQGTLVTVSS

SEQ ID NO: 2622 - protein, 11 aa, Artificial Sequence
  Description of Artificial Sequence: Synthetic peptide
WGQGTTVTVSS

SEQ ID NO: 2623 - protein, 4 aa, Artificial Sequence
  Description of Artificial Sequence: Synthetic peptide
GVHS

SEQ ID NO: 2624 - protein, 4 aa, Artificial Sequence
  Description of Artificial Sequence: Synthetic peptide
GVHS

SEQ ID NO: 2625 - protein, 4 aa, Artificial Sequence
  Description of Artificial Sequence: Synthetic peptide
GVHS

SEQ ID NO: 2626 - protein, 4 aa, Artificial Sequence
  Description of Artificial Sequence: Synthetic peptide
GVHS

SEQ ID NO: 2627 - protein, 4 aa, Artificial Sequence
  Description of Artificial Sequence: Synthetic peptide
GVHS

SEQ ID NO: 2628 - protein, 4 aa, Artificial Sequence
  Description of Artificial Sequence: Synthetic peptide
GVHS

SEQ ID NO: 2629 - protein, 4 aa, Artificial Sequence
  Description of Artificial Sequence: Synthetic peptide
GVHS

SEQ ID NO: 2630 - protein, 4 aa, Artificial Sequence
  Description of Artificial Sequence: Synthetic peptide
GVHS

SEQ ID NO: 2631 - protein, 4 aa, Artificial Sequence
  Description of Artificial Sequence: Synthetic peptide
GVHS

SEQ ID NO: 2632 - protein, 4 aa, Artificial Sequence
  Description of Artificial Sequence: Synthetic peptide
GVHS

SEQ ID NO: 2633 - protein, 4 aa, Artificial Sequence
  Description of Artificial Sequence: Synthetic peptide
GVHS

SEQ ID NO: 2634 - protein, 4 aa, Artificial Sequence
  Description of Artificial Sequence: Synthetic peptide
GVHS

SEQ ID NO: 2635 - protein, 4 aa, Artificial Sequence
  Description of Artificial Sequence: Synthetic peptide
GVHS

SEQ ID NO: 2636 - protein, 4 aa, Artificial Sequence
  Description of Artificial Sequence: Synthetic peptide
GVHS

SEQ ID NO: 2637 - protein, 4 aa, Artificial Sequence
  Description of Artificial Sequence: Synthetic peptide
GVHS

SEQ ID NO: 2638 - protein, 4 aa, Artificial Sequence
  Description of Artificial Sequence: Synthetic peptide
GVHS

SEQ ID NO: 2639 - protein, 4 aa, Artificial Sequence
  Description of Artificial Sequence: Synthetic peptide
GVHS

SEQ ID NO: 2640 - protein, 4 aa, Artificial Sequence
  Description of Artificial Sequence: Synthetic peptide
GVHS

SEQ ID NO: 2641 - protein, 4 aa, Artificial Sequence
  Description of Artificial Sequence: Synthetic peptide
GVHS

SEQ ID NO: 2642 - protein, 4 aa, Artificial Sequence
  Description of Artificial Sequence: Synthetic peptide
GVHS

SEQ ID NO: 2643 - protein, 4 aa, Artificial Sequence
  Description of Artificial Sequence: Synthetic peptide
GVHS

SEQ ID NO: 2644 - protein, 4 aa, Artificial Sequence
  Description of Artificial Sequence: Synthetic peptide
GVHS

SEQ ID NO: 2645 - protein, 23 aa, Artificial Sequence
  Description of Artificial Sequence: Synthetic peptide
DIQMTQSPSSLSASVGDRVTITC

SEQ ID NO: 2646 - protein, 23 aa, Artificial Sequence
  Description of Artificial Sequence: Synthetic peptide
DIQMTQSPSSLSASVGDRVTITC

SEQ ID NO: 2647 - protein, 23 aa, Artificial Sequence
  Description of Artificial Sequence: Synthetic peptide
DIQMTQSPSSLSASVGDRVTITC

SEQ ID NO: 2648 - protein, 23 aa, Artificial Sequence
  Description of Artificial Sequence: Synthetic peptide
DIQMTQSPSSLSASVGDRVTITC

SEQ ID NO: 2649 - protein, 23 aa, Artificial Sequence
  Description of Artificial Sequence: Synthetic peptide
DIQMTQSPSSLSASVGDRVTITC

SEQ ID NO: 2650 - protein, 23 aa, Artificial Sequence
  Description of Artificial Sequence: Synthetic peptide
DIQMTQSPSSLSASVGDRVTITC

SEQ ID NO: 2651 - protein, 23 aa, Artificial Sequence
  Description of Artificial Sequence: Synthetic peptide
DIQMTQSPSSLSASVGDRVTITC

SEQ ID NO: 2652 - protein, 23 aa, Artificial Sequence
  Description of Artificial Sequence: Synthetic peptide
DIQMTQSPSSLSASVGDRVTITC

SEQ ID NO: 2653 - protein, 23 aa, Artificial Sequence
  Description of Artificial Sequence: Synthetic peptide
DIQMTQSPSSLSASVGDRVTITC

SEQ ID NO: 2654 - protein, 23 aa, Artificial Sequence
  Description of Artificial Sequence: Synthetic peptide
DIQMTQSPSSLSASVGDRVTITC

SEQ ID NO: 2655 - protein, 23 aa, Artificial Sequence
  Description of Artificial Sequence: Synthetic peptide
DIQMTQSPSSLSASVGDRVTITC

SEQ ID NO: 2656 - protein, 23 aa, Artificial Sequence
  Description of Artificial Sequence: Synthetic peptide
DIQMTQSPSSLSASVGDRVTITC

SEQ ID NO: 2657 - protein, 23 aa, Artificial Sequence
  Description of Artificial Sequence: Synthetic peptide
DIQMTQSPSSLSASVGDRVTITC

SEQ ID NO: 2658 - protein, 23 aa, Artificial Sequence
  Description of Artificial Sequence: Synthetic peptide
DIQMTQSPSSLSASVGDRVTITC

SEQ ID NO: 2659 - protein, 23 aa, Artificial Sequence
  Description of Artificial Sequence: Synthetic peptide
DIQMTQSPSSLSASVGDRVTITC

SEQ ID NO: 2660 - protein, 23 aa, Artificial Sequence
  Description of Artificial Sequence: Synthetic peptide
DIQMTQSPSSLSASVGDRVTITC

SEQ ID NO: 2661 - protein, 23 aa, Artificial Sequence
  Description of Artificial Sequence: Synthetic peptide
DIQMTQSPSSLSASVGDRVTITC

SEQ ID NO: 2662 - protein, 23 aa, Artificial Sequence
  Description of Artificial Sequence: Synthetic peptide
DIQMTQSPSSLSASVGDRVTITC

SEQ ID NO: 2663 - protein, 23 aa, Artificial Sequence
  Description of Artificial Sequence: Synthetic peptide
DIQMTQSPSSLSASVGDRVTITC

SEQ ID NO: 2664 - protein, 23 aa, Artificial Sequence
  Description of Artificial Sequence: Synthetic peptide
DIQMTQSPSSLSASVGDRVTITC

SEQ ID NO: 2665 - protein, 23 aa, Artificial Sequence
  Description of Artificial Sequence: Synthetic peptide
DIQMTQSPSSLSASVGDRVTITC

SEQ ID NO: 2666 - protein, 23 aa, Artificial Sequence
  Description of Artificial Sequence: Synthetic peptide
DIQMTQSPSSLSASVGDRVTITC

SEQ ID NO: 2667 - protein, 11 aa, Artificial Sequence
  Description of Artificial Sequence: Synthetic peptide
RASQSIYTYLN

SEQ ID NO: 2668 - protein, 11 aa, Artificial Sequence
  Description of Artificial Sequence: Synthetic peptide
RASQSIYTYLN

SEQ ID NO: 2669 - protein, 11 aa, Artificial Sequence
  Description of Artificial Sequence: Synthetic peptide
RASQSIYTYLN

SEQ ID NO: 2670 - protein, 11 aa, Artificial Sequence
  Description of Artificial Sequence: Synthetic peptide
RASQSIYTYLN

SEQ ID NO: 2671 - protein, 11 aa, Artificial Sequence
  Description of Artificial Sequence: Synthetic peptide
RASQSIYTYLN

SEQ ID NO: 2672 - protein, 11 aa, Artificial Sequence
  Description of Artificial Sequence: Synthetic peptide
RASQSIYTYLN

SEQ ID NO: 2673 - protein, 11 aa, Artificial Sequence
  Description of Artificial Sequence: Synthetic peptide
RANQSIYTYLN

SEQ ID NO: 2674 - protein, 11 aa, Artificial Sequence
  Description of Artificial Sequence: Synthetic peptide
RASQSIYTYLN

SEQ ID NO: 2675 - protein, 11 aa, Artificial Sequence
  Description of Artificial Sequence: Synthetic peptide
RASQSIYTYLN

SEQ ID NO: 2676 - protein, 11 aa, Artificial Sequence
  Description of Artificial Sequence: Synthetic peptide
RASQSIYTYLN

SEQ ID NO: 2677 - protein, 11 aa, Artificial Sequence
  Description of Artificial Sequence: Synthetic peptide
RANQSIYTYLN

SEQ ID NO: 2678 - protein, 11 aa, Artificial Sequence
  Description of Artificial Sequence: Synthetic peptide
RANQSIYTYLN

SEQ ID NO: 2679 - protein, 11 aa, Artificial Sequence
  Description of Artificial Sequence: Synthetic peptide
RANQSIYTYLN

SEQ ID NO: 2680 - protein, 11 aa, Artificial Sequence
  Description of Artificial Sequence: Synthetic peptide
RANQSIYTYLN

SEQ ID NO: 2681 - protein, 11 aa, Artificial Sequence
  Description of Artificial Sequence: Synthetic peptide
RANQSIYTYLN

SEQ ID NO: 2682 - protein, 11 aa, Artificial Sequence
  Description of Artificial Sequence: Synthetic peptide
RANQSIYTYLN

SEQ ID NO: 2683 - protein, 11 aa, Artificial Sequence
  Description of Artificial Sequence: Synthetic peptide
RANQSIYTYLN

SEQ ID NO: 2684 - protein, 11 aa, Artificial Sequence
  Description of Artificial Sequence: Synthetic peptide
RANQSIYTYLN

SEQ ID NO: 2685 - protein, 11 aa, Artificial Sequence
  Description of Artificial Sequence: Synthetic peptide
RANQSIYTYLN

SEQ ID NO: 2686 - protein, 11 aa, Artificial Sequence
  Description of Artificial Sequence: Synthetic peptide
RANQSIYTYLN

SEQ ID NO: 2687 - protein, 11 aa, Artificial Sequence
  Description of Artificial Sequence: Synthetic peptide
RANQSIYTYLN

SEQ ID NO: 2688 - protein, 11 aa, Artificial Sequence
  Description of Artificial Sequence: Synthetic peptide
RANQSIYTYLN

SEQ ID NO: 2689 - protein, 15 aa, Artificial Sequence
  Description of Artificial Sequence: Synthetic peptide
WYQQKPGKAPKLLIY

SEQ ID NO: 2690 - protein, 15 aa, Artificial Sequence
  Description of Artificial Sequence: Synthetic peptide
WYQQKPGKAPKLLIY

SEQ ID NO: 2691 - protein, 15 aa, Artificial Sequence
  Description of Artificial Sequence: Synthetic peptide
WYQQKPGKAPKLLIY

SEQ ID NO: 2692 - protein, 15 aa, Artificial Sequence
  Description of Artificial Sequence: Synthetic peptide
WYQQKPGKAPKLLIY

SEQ ID NO: 2693 - protein, 15 aa, Artificial Sequence
  Description of Artificial Sequence: Synthetic peptide
WYQQKPGKAPKLLIY

SEQ ID NO: 2694 - protein, 15 aa, Artificial Sequence
  Description of Artificial Sequence: Synthetic peptide
WYQQKPGKAPKLLIY

SEQ ID NO: 2695 - protein, 15 aa, Artificial Sequence
  Description of Artificial Sequence: Synthetic peptide
WYQQKPGKAPKLLIY

SEQ ID NO: 2696 - protein, 15 aa, Artificial Sequence
  Description of Artificial Sequence: Synthetic peptide
WYQQKPGKAPKLLIY

SEQ ID NO: 2697 - protein, 15 aa, Artificial Sequence
  Description of Artificial Sequence: Synthetic peptide
WYQQKPGKAPKLLIY

SEQ ID NO: 2698 - protein, 15 aa, Artificial Sequence
  Description of Artificial Sequence: Synthetic peptide
WYQQKPGKAPKLLIY

SEQ ID NO: 2699 - protein, 15 aa, Artificial Sequence
  Description of Artificial Sequence: Synthetic peptide
WYQQKPGKAPKLLIY

SEQ ID NO: 2700 - protein, 15 aa, Artificial Sequence
  Description of Artificial Sequence: Synthetic peptide
WYQQKPGKAPKLLIY

SEQ ID NO: 2701 - protein, 15 aa, Artificial Sequence
  Description of Artificial Sequence: Synthetic peptide
WYQQKPGKAPKLLIY

SEQ ID NO: 2702 - protein, 15 aa, Artificial Sequence
  Description of Artificial Sequence: Synthetic peptide
WYQQKPGKAPKLLIY

SEQ ID NO: 2703 - protein, 15 aa, Artificial Sequence
  Description of Artificial Sequence: Synthetic peptide
WYQQKPGKAPKLLIY

SEQ ID NO: 2704 - protein, 15 aa, Artificial Sequence
  Description of Artificial Sequence: Synthetic peptide
WYQQKPGKAPKLLIY

SEQ ID NO: 2705 - protein, 15 aa, Artificial Sequence
  Description of Artificial Sequence: Synthetic peptide
WYQQKPGKAPKLLIY

SEQ ID NO: 2706 - protein, 15 aa, Artificial Sequence
  Description of Artificial Sequence: Synthetic peptide
WYQQKPGKAPKLLIY

SEQ ID NO: 2707 - protein, 15 aa, Artificial Sequence
  Description of Artificial Sequence: Synthetic peptide
WYQQKPGKAPKLLIY

SEQ ID NO: 2708 - protein, 15 aa, Artificial Sequence
  Description of Artificial Sequence: Synthetic peptide
WYQQKPGKAPKLLIY

SEQ ID NO: 2709 - protein, 15 aa, Artificial Sequence
  Description of Artificial Sequence: Synthetic peptide
WYQQKPGKAPKLLIY

SEQ ID NO: 2710 - protein, 15 aa, Artificial Sequence
  Description of Artificial Sequence: Synthetic peptide
WYQQKPGKAPKLLIY

SEQ ID NO: 2711 - protein, 7 aa, Artificial Sequence
  Description of Artificial Sequence: Synthetic peptide
AASSLQS

SEQ ID NO: 2712 - protein, 7 aa, Artificial Sequence
  Description of Artificial Sequence: Synthetic peptide
AASSLQS

SEQ ID NO: 2713 - protein, 7 aa, Artificial Sequence
  Description of Artificial Sequence: Synthetic peptide
AASSLQS

SEQ ID NO: 2714 - protein, 7 aa, Artificial Sequence
  Description of Artificial Sequence: Synthetic peptide
AASSLQS

SEQ ID NO: 2715 - protein, 7 aa, Artificial Sequence
  Description of Artificial Sequence: Synthetic peptide
AASSLQS

SEQ ID NO: 2716 - protein, 7 aa, Artificial Sequence
  Description of Artificial Sequence: Synthetic peptide
AASSLQS

SEQ ID NO: 2717 - protein, 7 aa, Artificial Sequence
  Description of Artificial Sequence: Synthetic peptide
AASSLQS

SEQ ID NO: 2718 - protein, 7 aa, Artificial Sequence
  Description of Artificial Sequence: Synthetic peptide
AASSLQS

SEQ ID NO: 2719 - protein, 7 aa, Artificial Sequence
  Description of Artificial Sequence: Synthetic peptide
AASSLQS

SEQ ID NO: 2720 - protein, 7 aa, Artificial Sequence
  Description of Artificial Sequence: Synthetic peptide
AASSLQS

SEQ ID NO: 2721 - protein, 7 aa, Artificial Sequence
  Description of Artificial Sequence: Synthetic peptide
AASSLQS

SEQ ID NO: 2722 - protein, 7 aa, Artificial Sequence
  Description of Artificial Sequence: Synthetic peptide
AASSLQS

SEQ ID NO: 2723 - protein, 7 aa, Artificial Sequence
  Description of Artificial Sequence: Synthetic peptide
AASSLQS

SEQ ID NO: 2724 - protein, 7 aa, Artificial Sequence
  Description of Artificial Sequence: Synthetic peptide
AASSLQS

SEQ ID NO: 2725 - protein, 7 aa, Artificial Sequence
  Description of Artificial Sequence: Synthetic peptide
AASSLQS

SEQ ID NO: 2726 - protein, 7 aa, Artificial Sequence
  Description of Artificial Sequence: Synthetic peptide
AASSLQS

SEQ ID NO: 2727 - protein, 7 aa, Artificial Sequence
  Description of Artificial Sequence: Synthetic peptide
AASSLQS

SEQ ID NO: 2728 - protein, 7 aa, Artificial Sequence
  Description of Artificial Sequence: Synthetic peptide
AASSLQS

SEQ ID NO: 2729 - protein, 7 aa, Artificial Sequence
  Description of Artificial Sequence: Synthetic peptide
AASSLQS

SEQ ID NO: 2730 - protein, 7 aa, Artificial Sequence
  Description of Artificial Sequence: Synthetic peptide
AASSLQS

SEQ ID NO: 2731 - protein, 7 aa, Artificial Sequence
  Description of Artificial Sequence: Synthetic peptide
AASSLQS

SEQ ID NO: 2732 - protein, 7 aa, Artificial Sequence
  Description of Artificial Sequence: Synthetic peptide
AASSLQS

SEQ ID NO: 2733 - protein, 32 aa, Artificial Sequence; identical to SEQ ID NO: 186
  Description of Artificial Sequence: Synthetic polypeptide

SEQ ID NO: 2734 - protein, 32 aa, Artificial Sequence; identical to SEQ ID NO: 186
  Description of Artificial Sequence: Synthetic polypeptide

SEQ ID NO: 2735 - protein, 32 aa, Artificial Sequence; identical to SEQ ID NO: 186
  Description of Artificial Sequence: Synthetic polypeptide

SEQ ID NO: 2736 - protein, 32 aa, Artificial Sequence; identical to SEQ ID NO: 186
  Description of Artificial Sequence: Synthetic polypeptide

SEQ ID NO: 2737 - protein, 32 aa, Artificial Sequence; identical to SEQ ID NO: 186
  Description of Artificial Sequence: Synthetic polypeptide

SEQ ID NO: 2738 - protein, 32 aa, Artificial Sequence; identical to SEQ ID NO: 186
  Description of Artificial Sequence: Synthetic polypeptide

SEQ ID NO: 2739 - protein, 32 aa, Artificial Sequence; identical to SEQ ID NO: 186
  Description of Artificial Sequence: Synthetic polypeptide

SEQ ID NO: 2740 - protein, 32 aa, Artificial Sequence; identical to SEQ ID NO: 186
  Description of Artificial Sequence: Synthetic polypeptide

SEQ ID NO: 2741 - protein, 32 aa, Artificial Sequence; identical to SEQ ID NO: 186
  Description of Artificial Sequence: Synthetic polypeptide

SEQ ID NO: 2742 - protein, 32 aa, Artificial Sequence; identical to SEQ ID NO: 186
  Description of Artificial Sequence: Synthetic polypeptide

SEQ ID NO: 2743 - protein, 32 aa, Artificial Sequence; identical to SEQ ID NO: 186
  Description of Artificial Sequence: Synthetic polypeptide

SEQ ID NO: 2744 - protein, 32 aa, Artificial Sequence; identical to SEQ ID NO: 186
  Description of Artificial Sequence: Synthetic polypeptide

SEQ ID NO: 2745 - protein, 32 aa, Artificial Sequence; identical to SEQ ID NO: 186
  Description of Artificial Sequence: Synthetic polypeptide

SEQ ID NO: 2746 - protein, 32 aa, Artificial Sequence; identical to SEQ ID NO: 186
  Description of Artificial Sequence: Synthetic polypeptide

SEQ ID NO: 2747 - protein, 32 aa, Artificial Sequence; identical to SEQ ID NO: 186
  Description of Artificial Sequence: Synthetic polypeptide

SEQ ID NO: 2748 - protein, 32 aa, Artificial Sequence; identical to SEQ ID NO: 186
  Description of Artificial Sequence: Synthetic polypeptide

SEQ ID NO: 2749 - protein, 32 aa, Artificial Sequence; identical to SEQ ID NO: 186
  Description of Artificial Sequence: Synthetic polypeptide

SEQ ID NO: 2750 - protein, 32 aa, Artificial Sequence; identical to SEQ ID NO: 186
  Description of Artificial Sequence: Synthetic polypeptide

SEQ ID NO: 2751 - protein, 32 aa, Artificial Sequence; identical to SEQ ID NO: 186
  Description of Artificial Sequence: Synthetic polypeptide

SEQ ID NO: 2752 - protein, 32 aa, Artificial Sequence; identical to SEQ ID NO: 186
  Description of Artificial Sequence: Synthetic polypeptide

SEQ ID NO: 2753 - protein, 32 aa, Artificial Sequence; identical to SEQ ID NO: 186
  Description of Artificial Sequence: Synthetic polypeptide

SEQ ID NO: 2754 - protein, 32 aa, Artificial Sequence; identical to SEQ ID NO: 186
  Description of Artificial Sequence: Synthetic polypeptide

SEQ ID NO: 2755 - protein, 5 aa, Artificial Sequence
  Description of Artificial Sequence: Synthetic peptide
QQAGI

SEQ ID NO: 2756 - protein, 5 aa, Artificial Sequence
  Description of Artificial Sequence: Synthetic peptide
QQAGI

SEQ ID NO: 2757 - protein, 5 aa, Artificial Sequence
  Description of Artificial Sequence: Synthetic peptide
QQAGI

SEQ ID NO: 2758 - protein, 5 aa, Artificial Sequence
  Description of Artificial Sequence: Synthetic peptide
QQAGI

SEQ ID NO: 2759 - protein, 5 aa, Artificial Sequence
  Description of Artificial Sequence: Synthetic peptide
QQAGI

SEQ ID NO: 2760 - protein, 5 aa, Artificial Sequence
  Description of Artificial Sequence: Synthetic peptide
QQAGI

SEQ ID NO: 2761 - protein, 5 aa, Artificial Sequence
  Description of Artificial Sequence: Synthetic peptide
QQAGI

SEQ ID NO: 2762 - protein, 5 aa, Artificial Sequence
  Description of Artificial Sequence: Synthetic peptide
QQAGI

SEQ ID NO: 2763 - protein, 5 aa, Artificial Sequence
  Description of Artificial Sequence: Synthetic peptide
QQAGI

SEQ ID NO: 2764 - protein, 5 aa, Artificial Sequence
  Description of Artificial Sequence: Synthetic peptide
QQAGI

SEQ ID NO: 2765 - protein, 5 aa, Artificial Sequence
  Description of Artificial Sequence: Synthetic peptide
QQAGI

SEQ ID NO: 2766 - protein, 5 aa, Artificial Sequence
  Description of Artificial Sequence: Synthetic peptide
QQAGI

SEQ ID NO: 2767 - protein, 5 aa, Artificial Sequence
  Description of Artificial Sequence: Synthetic peptide
QQAGI

SEQ ID NO: 2768 - protein, 5 aa, Artificial Sequence
  Description of Artificial Sequence: Synthetic peptide
QQAGI

SEQ ID NO: 2769 - protein, 5 aa, Artificial Sequence
  Description of Artificial Sequence: Synthetic peptide
QQAGI

SEQ ID NO: 2770 - protein, 5 aa, Artificial Sequence
  Description of Artificial Sequence: Synthetic peptide
QQAGI

SEQ ID NO: 2771 - protein, 5 aa, Artificial Sequence
  Description of Artificial Sequence: Synthetic peptide
QQAGI

SEQ ID NO: 2772 - protein, 5 aa, Artificial Sequence
  Description of Artificial Sequence: Synthetic peptide
QQAGI

SEQ ID NO: 2773 - protein, 5 aa, Artificial Sequence
  Description of Artificial Sequence: Synthetic peptide
QQAGI

SEQ ID NO: 2774 - protein, 5 aa, Artificial Sequence
  Description of Artificial Sequence: Synthetic peptide
QQAGI

SEQ ID NO: 2775 - protein, 5 aa, Artificial Sequence
  Description of Artificial Sequence: Synthetic peptide
QQAGI

SEQ ID NO: 2776 - protein, 5 aa, Artificial Sequence
  Description of Artificial Sequence: Synthetic peptide
QQAGI

SEQ ID NO: 2777 - protein, 10 aa, Artificial Sequence
  Description of Artificial Sequence: Synthetic peptide
FGQGTKLEIK

SEQ ID NO: 2778 - protein, 10 aa, Artificial Sequence
  Description of Artificial Sequence: Synthetic peptide
FGQGTKLEIK

SEQ ID NO: 2779 - protein, 10 aa, Artificial Sequence
  Description of Artificial Sequence: Synthetic peptide
FGQGTKLEIK

SEQ ID NO: 2780 - protein, 10 aa, Artificial Sequence
  Description of Artificial Sequence: Synthetic peptide
FGQGTKLEIK

SEQ ID NO: 2781 - protein, 10 aa, Artificial Sequence
  Description of Artificial Sequence: Synthetic peptide
FGQGTKLEIK

SEQ ID NO: 2782 - protein, 10 aa, Artificial Sequence
  Description of Artificial Sequence: Synthetic peptide
FGQGTKLEIK

SEQ ID NO: 2783 - protein, 10 aa, Artificial Sequence
  Description of Artificial Sequence: Synthetic peptide
FGQGTKLEIK

SEQ ID NO: 2784 - protein, 10 aa, Artificial Sequence
  Description of Artificial Sequence: Synthetic peptide
FGQGTKLEIK

SEQ ID NO: 2785 - protein, 10 aa, Artificial Sequence
  Description of Artificial Sequence: Synthetic peptide
FGQGTKLEIK

SEQ ID NO: 2786 - protein, 10 aa, Artificial Sequence
  Description of Artificial Sequence: Synthetic peptide
FGQGTKLEIK

SEQ ID NO: 2787 - protein, 10 aa, Artificial Sequence
  Description of Artificial Sequence: Synthetic peptide
FGQGTKLEIK

SEQ ID NO: 2788 - protein, 10 aa, Artificial Sequence
  Description of Artificial Sequence: Synthetic peptide
FGQGTKLEIK

SEQ ID NO: 2789 - protein, 10 aa, Artificial Sequence
  Description of Artificial Sequence: Synthetic peptide
FGQGTKLEIK

SEQ ID NO: 2790 - protein, 10 aa, Artificial Sequence
  Description of Artificial Sequence: Synthetic peptide
FGQGTKLEIK

SEQ ID NO: 2791 - protein, 10 aa, Artificial Sequence
  Description of Artificial Sequence: Synthetic peptide
FGQGTKLEIK

SEQ ID NO: 2792 - protein, 10 aa, Artificial Sequence
  Description of Artificial Sequence: Synthetic peptide
FGQGTKLEIK

SEQ ID NO: 2793 - protein, 10 aa, Artificial Sequence
  Description of Artificial Sequence: Synthetic peptide
FGQGTKLEIK

SEQ ID NO: 2794 - protein, 10 aa, Artificial Sequence
  Description of Artificial Sequence: Synthetic peptide
FGQGTKLEIK

SEQ ID NO: 2795 - protein, 10 aa, Artificial Sequence
  Description of Artificial Sequence: Synthetic peptide
FGQGTKLEIK

SEQ ID NO: 2796 - protein, 10 aa, Artificial Sequence
  Description of Artificial Sequence: Synthetic peptide
FGQGTKLEIK

SEQ ID NO: 2797 - protein, 10 aa, Artificial Sequence
  Description of Artificial Sequence: Synthetic peptide
FGQGTKLEIK

SEQ ID NO: 2798 - protein, 10 aa, Artificial Sequence
  Description of Artificial Sequence: Synthetic peptide
FGQGTKLEIK

SEQ ID NO: 2799 - protein, 107 aa, Artificial Sequence [sequence omitted]

SEQ ID NO: 2800 - protein, 107 aa, Artificial Sequence [sequence omitted]

SEQ ID NO: 2801 - protein, 107 aa, Artificial Sequence [sequence omitted]

SEQ ID NO: 2802 - protein, 107 aa, Artificial Sequence [sequence omitted]

SEQ ID NO: 2803 - protein, 7 aa, Artificial Sequence
  Description of Artificial Sequence: Synthetic peptide
RTVAAPS

SEQ ID NO: 2804 - protein, 107 aa, Artificial Sequence
  Description of Artificial Sequence: Synthetic polypeptide
RTVAAPSVFIFPPSDEQLKSGTASVVCLLNNFYPREAKVQWKVDNALQSGNSQESVTEQDSKDSZYSLSSTLTLSKADYEKHKVYACEVTHQGLSSPVTKSFNRGEC

SEQ ID NO: 2805 - protein, 107 aa, Artificial Sequence; identical to SEQ ID NO: 2804
  Description of Artificial Sequence: Synthetic polypeptide

SEQ ID NO: 2806 - protein, 107 aa, Artificial Sequence
  Description of Artificial Sequence: Synthetic polypeptide
RTVAAPSVFIFPPSDEQLKSGTASVVCLLNNFYPREAKVQWKVDNALQSGNSQESVTEQDSKDZZYSLSSTLTLSKADYEKHKVYACEVTHQGLSSPVTKSFNRGEC

SEQ ID NO: 2807 - protein, 109 aa, Artificial Sequence
  Description of Artificial Sequence: Synthetic polypeptide
RTVAAPSVFIFPPSDEQLKSGTASVVCLLNNFYPREAKVQWKVDNALQSGNSQESVTEQDSKDSZLLPVQHPDPVQGRLREAQGVRLRGDPPGPVLPRDQVLQPGRVLM

SEQ ID NO: 2808 - protein, 107 aa, Artificial Sequence; identical to SEQ ID NO: 2804
  Description of Artificial Sequence: Synthetic polypeptide

SEQ ID NO: 2809 - protein, 107 aa, Artificial Sequence; identical to SEQ ID NO: 2806
  Description of Artificial Sequence: Synthetic polypeptide

SEQ ID NO: 2810 - protein, 107 aa, Artificial Sequence; identical to SEQ ID NO: 2806
  Description of Artificial Sequence: Synthetic polypeptide

SEQ ID NO: 2811 - protein, 107 aa, Artificial Sequence; identical to SEQ ID NO: 2806
  Description of Artificial Sequence: Synthetic polypeptide

SEQ ID NO: 2812 - protein, 7 aa, Artificial Sequence
  Description of Artificial Sequence: Synthetic peptide
RTVAAPS

SEQ ID NO: 2813 - protein, 19 aa, Artificial Sequence
  Description of Artificial Sequence: Synthetic peptide
MGWSCIILFLVATATGAHS

SEQ ID NO: 2814 - protein, 19 aa, Artificial Sequence
  Description of Artificial Sequence: Synthetic peptide
MGWSCIILFLVATATGAHS

SEQ ID NO: 2815 - protein, 19 aa, Artificial Sequence
  Description of Artificial Sequence: Synthetic peptide
MGWSCIILFLVATATGAHS

SEQ ID NO: 2816 - protein, 19 aa, Artificial Sequence
  Description of Artificial Sequence: Synthetic peptide
MGWSCIILFLVATATGAHS

SEQ ID NO: 2817 - protein, 19 aa, Artificial Sequence
  Description of Artificial Sequence: Synthetic peptide
MGWSCIILFLVATATGAHS

SEQ ID NO: 2818 - protein, 19 aa, Artificial Sequence
  Description of Artificial Sequence: Synthetic peptide
MGWSCIILFLVATATGAHS

SEQ ID NO: 2819 - protein, 19 aa, Artificial Sequence
  Description of Artificial Sequence: Synthetic peptide
MGWSCIILFLVATATGAHS

SEQ ID NO: 2820 - protein, 19 aa, Artificial Sequence
  Description of Artificial Sequence: Synthetic peptide
MGWSCIILFLVATATGAHS

SEQ ID NO: 2821 - protein, 19 aa, Artificial Sequence
  Description of Artificial Sequence: Synthetic peptide
MGWSCIILFLVATATGAHS

SEQ ID NO: 2822 - protein, 19 aa, Artificial Sequence
  Description of Artificial Sequence: Synthetic peptide
MGWSCIILFLVATATGAHS

SEQ ID NO: 2823 - protein, 19 aa, Artificial Sequence
  Description of Artificial Sequence: Synthetic peptide
MGWSCIILFLVATATGAHS

SEQ ID NO: 2824 - protein, 19 aa, Artificial Sequence
  Description of Artificial Sequence: Synthetic peptide
MGWSCIILFLVATATGAHS

SEQ ID NO: 2825 - protein, 19 aa, Artificial Sequence
  Description of Artificial Sequence: Synthetic peptide
MGWSCIILFLVATATGAHS

SEQ ID NO: 2826 - protein, 19 aa, Artificial Sequence
  Description of Artificial Sequence: Synthetic peptide
MGWSCIILFLVATATGAHS

SEQ ID NO: 2827 - protein, 19 aa, Artificial Sequence
  Description of Artificial Sequence: Synthetic peptide
MGWSCIILFLVATATGAHS

SEQ ID NO: 2828 - protein, 19 aa, Artificial Sequence
  Description of Artificial Sequence: Synthetic peptide
MGWSCIILFLVATATGAHS

SEQ ID NO: 2829 - protein, 19 aa, Artificial Sequence
  Description of Artificial Sequence: Synthetic peptide
MGWSCIILFLVATATGAHS

SEQ ID NO: 2830 - protein, 19 aa, Artificial Sequence
  Description of Artificial Sequence: Synthetic peptide
MGWSCIILFLVATATGAHS

SEQ ID NO: 2831 - protein, 19 aa, Artificial Sequence
  Description of Artificial Sequence: Synthetic peptide
MGWSCIILFLVATATGAHS

SEQ ID NO: 2832 - protein, 19 aa, Artificial Sequence
  Description of Artificial Sequence: Synthetic peptide
MGWSCIILFLVATATGAHS

SEQ ID NO: 2833 - protein, 19 aa, Artificial Sequence
  Description of Artificial Sequence: Synthetic peptide
MGWSCIILFLVATATGAHS

SEQ ID NO: 2834 - protein, 19 aa, Artificial Sequence
  Description of Artificial Sequence: Synthetic peptide
MGWSCIILFLVATATGAHS

SEQ ID NO: 2835 - protein, 30 aa, Artificial Sequence; identical to SEQ ID NO: 322
  Description of Artificial Sequence: Synthetic polypeptide

SEQ ID NO: 2836 - protein, 30 aa, Artificial Sequence; identical to SEQ ID NO: 322
  Description of Artificial Sequence: Synthetic polypeptide

SEQ ID NO: 2837 - protein, 30 aa, Artificial Sequence; identical to SEQ ID NO: 322
  Description of Artificial Sequence: Synthetic polypeptide

SEQ ID NO: 2838 - protein, 30 aa, Artificial Sequence; identical to SEQ ID NO: 322
  Description of Artificial Sequence: Synthetic polypeptide

SEQ ID NO: 2839 - protein, 30 aa, Artificial Sequence; identical to SEQ ID NO: 322
  Description of Artificial Sequence: Synthetic polypeptide

SEQ ID NO: 2840 - protein, 30 aa, Artificial Sequence; identical to SEQ ID NO: 322
  Description of Artificial Sequence: Synthetic polypeptide

SEQ ID NO: 2841 - protein, 30 aa, Artificial Sequence; identical to SEQ ID NO: 322
  Description of Artificial Sequence: Synthetic polypeptide

SEQ ID NO: 2842 - protein, 30 aa, Artificial Sequence; identical to SEQ ID NO: 322
  Description of Artificial Sequence: Synthetic polypeptide

SEQ ID NO: 2843 - protein, 30 aa, Artificial Sequence; identical to SEQ ID NO: 322
  Description of Artificial Sequence: Synthetic polypeptide

SEQ ID NO: 2844 - protein, 30 aa, Artificial Sequence; identical to SEQ ID NO: 322
  Description of Artificial Sequence: Synthetic polypeptide

SEQ ID NO: 2845 - protein, 30 aa, Artificial Sequence; identical to SEQ ID NO: 322
  Description of Artificial Sequence: Synthetic polypeptide

SEQ ID NO: 2846 - protein, 30 aa, Artificial Sequence; identical to SEQ ID NO: 322
  Description of Artificial Sequence: Synthetic polypeptide

SEQ ID NO: 2847 - protein, 30 aa, Artificial Sequence; identical to SEQ ID NO: 322
  Description of Artificial Sequence: Synthetic polypeptide

SEQ ID NO: 2848 - protein, 30 aa, Artificial Sequence; identical to SEQ ID NO: 322
  Description of Artificial Sequence: Synthetic polypeptide

SEQ ID NO: 2849 - protein, 30 aa, Artificial Sequence; identical to SEQ ID NO: 322
  Description of Artificial Sequence: Synthetic polypeptide

SEQ ID NO: 2850 - protein, 30 aa, Artificial Sequence; identical to SEQ ID NO: 322
  Description of Artificial Sequence: Synthetic polypeptide

SEQ ID NO: 2851 - protein, 30 aa, Artificial Sequence; identical to SEQ ID NO: 322
  Description of Artificial Sequence: Synthetic polypeptide

SEQ ID NO: 2852 - protein, 30 aa, Artificial Sequence; identical to SEQ ID NO: 322
  Description of Artificial Sequence: Synthetic polypeptide

SEQ ID NO: 2853 - protein, 30 aa, Artificial Sequence; identical to SEQ ID NO: 322
  Description of Artificial Sequence: Synthetic polypeptide

SEQ ID NO: 2854 - protein, 30 aa, Artificial Sequence; identical to SEQ ID NO: 322
  Description of Artificial Sequence: Synthetic polypeptide

SEQ ID NO: 2855 - protein, 30 aa, Artificial Sequence; identical to SEQ ID NO: 322
  Description of Artificial Sequence: Synthetic polypeptide

SEQ ID NO: 2856 - protein, 30 aa, Artificial Sequence; identical to SEQ ID NO: 322
  Description of Artificial Sequence: Synthetic polypeptide

SEQ ID NO: 2857 - protein, 5 aa, Artificial Sequence
  Description of Artificial Sequence: Synthetic peptide
DYWMH

SEQ ID NO: 2858 - protein, 5 aa, Artificial Sequence
  Description of Artificial Sequence: Synthetic peptide
WYWMH

SEQ ID NO: 2859 - protein, 5 aa, Artificial Sequence
  Description of Artificial Sequence: Synthetic peptide
DYWMH

SEQ ID NO: 2860 - protein, 5 aa, Artificial Sequence
  Description of Artificial Sequence: Synthetic peptide
WYWMH

SEQ ID NO: 2861 - protein, 5 aa, Artificial Sequence
  Description of Artificial Sequence: Synthetic peptide
WYWMH

SEQ ID NO: 2862 - protein, 5 aa, Artificial Sequence
  Description of Artificial Sequence: Synthetic peptide
WYWMH

SEQ ID NO: 2863 - protein, 5 aa, Artificial Sequence
  Description of Artificial Sequence: Synthetic peptide
WYWMH

SEQ ID NO: 2864 - protein, 5 aa, Artificial Sequence
  Description of Artificial Sequence: Synthetic peptide
DYWMH

SEQ ID NO: 2865 - protein, 5 aa, Artificial Sequence
  Description of Artificial Sequence: Synthetic peptide
WYWMH

SEQ ID NO: 2866 - protein, 5 aa, Artificial Sequence
  Description of Artificial Sequence: Synthetic peptide
WYWMH

SEQ ID NO: 2867 - protein, 5 aa, Artificial Sequence
  Description of Artificial Sequence: Synthetic peptide
DYNMH

SEQ ID NO: 2868 - protein, 5 aa, Artificial Sequence
  Description of Artificial Sequence: Synthetic peptide
WYGMH

SEQ ID NO: 2869 - protein, 5 aa, Artificial Sequence
  Description of Artificial Sequence: Synthetic peptide
WYWMH

SEQ ID NO: 2870 - protein, 5 aa, Artificial Sequence
  Description of Artificial Sequence: Synthetic peptide
DYWMH

SEQ ID NO: 2871 - protein, 5 aa, Artificial Sequence
  Description of Artificial Sequence: Synthetic peptide
WYWMH

SEQ ID NO: 2872 - protein, 5 aa, Artificial Sequence
  Description of Artificial Sequence: Synthetic peptide
DYWMH

SEQ ID NO: 2873 - protein, 5 aa, Artificial Sequence
  Description of Artificial Sequence: Synthetic peptide
WYWMH

SEQ ID NO: 2874 - protein, 5 aa, Artificial Sequence
  Description of Artificial Sequence: Synthetic peptide
WYWMH

SEQ ID NO: 2875 - protein, 5 aa, Artificial Sequence
  Description of Artificial Sequence: Synthetic peptide
WYWMH

SEQ ID NO: 2876 - protein, 5 aa, Artificial Sequence
  Description of Artificial Sequence: Synthetic peptide
WYWMH

SEQ ID NO: 2877 - protein, 5 aa, Artificial Sequence
  Description of Artificial Sequence: Synthetic peptide
DYWMH

SEQ ID NO: 2878 - protein, 5 aa, Artificial Sequence
  Description of Artificial Sequence: Synthetic peptide
WYWMH

SEQ ID NO: 2879 - protein, 14 aa, Artificial Sequence
  Description of Artificial Sequence: Synthetic peptide
WVRQAPGKGLEWVS

SEQ ID NO: 2880 - protein, 14 aa, Artificial Sequence
  Description of Artificial Sequence: Synthetic peptide
WVRQAPGKGLEWVS

SEQ ID NO: 2881 - protein, 14 aa, Artificial Sequence
  Description of Artificial Sequence: Synthetic peptide
WVRQAPGKGLEWVS

SEQ ID NO: 2882 - protein, 14 aa, Artificial Sequence
  Description of Artificial Sequence: Synthetic peptide
WVRQAPGKGLEWVS

SEQ ID NO: 2883 - protein, 14 aa, Artificial Sequence
  Description of Artificial Sequence: Synthetic peptide
WVRQAPGKGLEWVS

SEQ ID NO: 2884 - protein, 14 aa, Artificial Sequence
  Description of Artificial Sequence: Synthetic peptide
WVRQAPGKGLEWVS

SEQ ID NO: 2885 - protein, 14 aa, Artificial Sequence
  Description of Artificial Sequence: Synthetic peptide
WVRQAPGKGLEWVS

SEQ ID NO: 2886 - protein, 14 aa, Artificial Sequence
  Description of Artificial Sequence: Synthetic peptide
WVRQAPGKGLEWVS

SEQ ID NO: 2887 - protein, 14 aa, Artificial Sequence
  Description of Artificial Sequence: Synthetic peptide
WVRQAPGKGLEWVS

SEQ ID NO: 2888 - protein, 14 aa, Artificial Sequence
  Description of Artificial Sequence: Synthetic peptide
WVRQAPGKGLEWVS

SEQ ID NO: 2889 - protein, 14 aa, Artificial Sequence
  Description of Artificial Sequence: Synthetic peptide
WVRQAPGKGLEWVS

SEQ ID NO: 2890 - protein, 14 aa, Artificial Sequence
  Description of Artificial Sequence: Synthetic peptide
WVRQAPGKGLEWVS

SEQ ID NO: 2891 - protein, 14 aa, Artificial Sequence
  Description of Artificial Sequence: Synthetic peptide
WVRQAPGKGLEWVS

SEQ ID NO: 2892 - protein, 14 aa, Artificial Sequence
  Description of Artificial Sequence: Synthetic peptide
WVRQAPGKGLEWVS

SEQ ID NO: 2893 - protein, 14 aa, Artificial Sequence
  Description of Artificial Sequence: Synthetic peptide
WVRQAPGKGLEWVS

SEQ ID NO: 2894 - protein, 14 aa, Artificial Sequence
  Description of Artificial Sequence: Synthetic peptide
WVRQAPGKGLEWVS

SEQ ID NO: 2895 - protein, 14 aa, Artificial Sequence
  Description of Artificial Sequence: Synthetic peptide
WVRQAPGKGLEWVS

SEQ ID NO: 2896 - protein, 14 aa, Artificial Sequence
  Description of Artificial Sequence: Synthetic peptide
WVRQAPGKGLEWVS

SEQ ID NO: 2897 - protein, 14 aa, Artificial Sequence
  Description of Artificial Sequence: Synthetic peptide
WVRQAPGKGLEWVS

SEQ ID NO: 2898 - protein, 14 aa, Artificial Sequence
  Description of Artificial Sequence: Synthetic peptide
WVRQAPGKGLEWVS

SEQ ID NO: 2899 - protein, 14 aa, Artificial Sequence
  Description of Artificial Sequence: Synthetic peptide
WVRQAPGKGLEWVS

SEQ ID NO: 2900 - protein, 14 aa, Artificial Sequence
  Description of Artificial Sequence: Synthetic peptide
WVRQAPGKGLEWVS

SEQ ID NO: 2901 - protein, 17 aa, Artificial Sequence
  Description of Artificial Sequence: Synthetic peptide
GISPSGGYTHYADSVKG

SEQ ID NO: 2902 - protein, 17 aa, Artificial Sequence
  Description of Artificial Sequence: Synthetic peptide
GISPSGGMTHYADSVKG

SEQ ID NO: 2903 - protein, 17 aa, Artificial Sequence
  Description of Artificial Sequence: Synthetic peptide
GISPSGGYTHYADSVKG

SEQ ID NO: 2904 - protein, 17 aa, Artificial Sequence
  Description of Artificial Sequence: Synthetic peptide
GISPSGGMTMYADSVKG

SEQ ID NO: 2905 - protein, 17 aa, Artificial Sequence
  Description of Artificial Sequence: Synthetic peptide
GISPSGGMTMYADSVKG

SEQ ID NO: 2906 - protein, 17 aa, Artificial Sequence
  Description of Artificial Sequence: Synthetic peptide
GISPSGGYTMYADSVKG

SEQ ID NO: 2907 - protein, 17 aa, Artificial Sequence
  Description of Artificial Sequence: Synthetic peptide
GISPSGGMTMYADSVKG

SEQ ID NO: 2908 - protein, 17 aa, Artificial Sequence
  Description of Artificial Sequence: Synthetic peptide
GISPSGGMTMYADSVKG

SEQ ID NO: 2909 - protein, 17 aa, Artificial Sequence
  Description of Artificial Sequence: Synthetic peptide
GISPSGGMTMYADSVKG

SEQ ID NO: 2910 - protein, 17 aa, Artificial Sequence
  Description of Artificial Sequence: Synthetic peptide
GISPSGGMTMYADSVKG

SEQ ID NO: 2911 - protein, 17 aa, Artificial Sequence
  Description of Artificial Sequence: Synthetic peptide
YIGPSGGYTHYADSVKG

SEQ ID NO: 2912 - protein, 17 aa, Artificial Sequence
  Description of Artificial Sequence: Synthetic peptide
GIVSSGGETFYADSVKG

SEQ ID NO: 2913 - protein, 17 aa, Artificial Sequence
  Description of Artificial Sequence: Synthetic peptide
GISPSGGMTMYADSVKG

SEQ ID NO: 2914 - protein, 17 aa, Artificial Sequence
  Description of Artificial Sequence: Synthetic peptide
GISPSGGYTHYADSVKG

SEQ ID NO: 2915 - protein, 17 aa, Artificial Sequence
  Description of Artificial Sequence: Synthetic peptide
GISPSGGMTMYADSVKG

SEQ ID NO: 2916 - protein, 17 aa, Artificial Sequence
  Description of Artificial Sequence: Synthetic peptide
GISPSGGYTHYADSVKG

SEQ ID NO: 2917 - protein, 17 aa, Artificial Sequence
  Description of Artificial Sequence: Synthetic peptide
GISPSGGMTMYADSVKG

SEQ ID NO: 2918 - protein, 17 aa, Artificial Sequence
  Description of Artificial Sequence: Synthetic peptide
GISPSGGMTMYADSVKG

SEQ ID NO: 2919 - protein, 17 aa, Artificial Sequence
  Description of Artificial Sequence: Synthetic peptide
GISPSGGMTMYADSVKG

SEQ ID NO: 2920 - protein, 17 aa, Artificial Sequence
  Description of Artificial Sequence: Synthetic peptide
GISPSGGMTMYADSVKG

SEQ ID NO: 2921 - protein, 17 aa, Artificial Sequence
  Description of Artificial Sequence: Synthetic peptide
GISPSGGMTMYADSVKG

SEQ ID NO: 2922 - protein, 17 aa, Artificial Sequence
  Description of Artificial Sequence: Synthetic peptide
GISPSGGYTMYADSVKG

SEQ ID NO: 2923 - protein, 32 aa, Artificial Sequence; identical to SEQ ID NO: 952
  Description of Artificial Sequence: Synthetic polypeptide

SEQ ID NO: 2924 - protein, 32 aa, Artificial Sequence; identical to SEQ ID NO: 952
  Description of Artificial Sequence: Synthetic polypeptide

SEQ ID NO: 2925 - protein, 32 aa, Artificial Sequence; identical to SEQ ID NO: 952
  Description of Artificial Sequence: Synthetic polypeptide

SEQ ID NO: 2926 - protein, 32 aa, Artificial Sequence; identical to SEQ ID NO: 952
  Description of Artificial Sequence: Synthetic polypeptide

SEQ ID NO: 2927 - protein, 32 aa, Artificial Sequence; identical to SEQ ID NO: 952
  Description of Artificial Sequence: Synthetic polypeptide

SEQ ID NO: 2928 - protein, 32 aa, Artificial Sequence; identical to SEQ ID NO: 952
  Description of Artificial Sequence: Synthetic polypeptide

SEQ ID NO: 2929 - protein, 32 aa, Artificial Sequence; identical to SEQ ID NO: 952
  Description of Artificial Sequence: Synthetic polypeptide

SEQ ID NO: 2930 - protein, 32 aa, Artificial Sequence; identical to SEQ ID NO: 952
  Description of Artificial Sequence: Synthetic polypeptide

SEQ ID NO: 2931 - protein, 32 aa, Artificial Sequence; identical to SEQ ID NO: 952
  Description of Artificial Sequence: Synthetic polypeptide

SEQ ID NO: 2932 - protein, 32 aa, Artificial Sequence; identical to SEQ ID NO: 952
  Description of Artificial Sequence: Synthetic polypeptide

SEQ ID NO: 2933 - protein, 32 aa, Artificial Sequence; identical to SEQ ID NO: 458
  Description of Artificial Sequence: Synthetic polypeptide

SEQ ID NO: 2934 - protein, 32 aa, Artificial Sequence; identical to SEQ ID NO: 458
  Description of Artificial Sequence: Synthetic polypeptide

SEQ ID NO: 2935 - protein, 32 aa, Artificial Sequence; identical to SEQ ID NO: 952
  Description of Artificial Sequence: Synthetic polypeptide

SEQ ID NO: 2936 - protein, 32 aa, Artificial Sequence; identical to SEQ ID NO: 952
  Description of Artificial Sequence: Synthetic polypeptide

SEQ ID NO: 2937 - protein, 32 aa, Artificial Sequence; identical to SEQ ID NO: 952
  Description of Artificial Sequence: Synthetic polypeptide

SEQ ID NO: 2938 - protein, 32 aa, Artificial Sequence; identical to SEQ ID NO: 952
  Description of Artificial Sequence: Synthetic polypeptide

SEQ ID NO: 2939 - protein, 32 aa, Artificial Sequence; identical to SEQ ID NO: 952
  Description of Artificial Sequence: Synthetic polypeptide

SEQ ID NO: 2940 - protein, 32 aa, Artificial Sequence; identical to SEQ ID NO: 952
  Description of Artificial Sequence: Synthetic polypeptide

SEQ ID NO: 2941 - protein, 32 aa, Artificial Sequence; identical to SEQ ID NO: 952
  Description of Artificial Sequence: Synthetic polypeptide

SEQ ID NO: 2942 - protein, 32 aa, Artificial Sequence; identical to SEQ ID NO: 952
  Description of Artificial Sequence: Synthetic polypeptide

SEQ ID NO: 2943 - protein, 32 aa, Artificial Sequence; identical to SEQ ID NO: 952
  Description of Artificial Sequence: Synthetic polypeptide

SEQ ID NO: 2944 - protein, 32 aa, Artificial Sequence; identical to SEQ ID NO: 952
  Description of Artificial Sequence: Synthetic polypeptide

SEQ ID NO: 2945 - protein, 13 aa, Artificial Sequence
  Description of Artificial Sequence: Synthetic peptide
DIVGPYSAGLFDY

SEQ ID NO: 2946 - protein, 13 aa, Artificial Sequence
  Description of Artificial Sequence: Synthetic peptide
DIVGPYSAGLFDY

SEQ ID NO: 2947 - protein, 13 aa, Artificial Sequence
  Description of Artificial Sequence: Synthetic peptide
DIRGAYSSGLFDY

SEQ ID NO: 2948 - protein, 13 aa, Artificial Sequence
  Description of Artificial Sequence: Synthetic peptide
DIRGPYSAGLFDY

SEQ ID NO: 2949 - protein, 13 aa, Artificial Sequence
  Description of Artificial Sequence: Synthetic peptide
DIRGAYSSGLFDY

SEQ ID NO: 2950 - protein, 13 aa, Artificial Sequence
  Description of Artificial Sequence: Synthetic peptide
DIVGPYSAGLFDY

SEQ ID NO: 2951 - protein, 13 aa, Artificial Sequence
  Description of Artificial Sequence: Synthetic peptide
DIVGPYSAGLFDY

SEQ ID NO: 2952 - protein, 13 aa, Artificial Sequence
  Description of Artificial Sequence: Synthetic peptide
DIVGPYSAGLFDY

SEQ ID NO: 2953 - protein, 13 aa, Artificial Sequence
  Description of Artificial Sequence: Synthetic peptide
DIVGAYSAGLFDY

SEQ ID NO: 2954 - protein, 13 aa, Artificial Sequence
  Description of Artificial Sequence: Synthetic peptide
DIVGPYSSGLFDY

SEQ ID NO: 2955 - protein, 13 aa, Artificial Sequence
  Description of Artificial Sequence: Synthetic peptide
DIRGAYSSGLFDY

SEQ ID NO: 2956 - protein, 13 aa, Artificial Sequence
  Description of Artificial Sequence: Synthetic peptide
DIRGVFLSGLFDH

SEQ ID NO: 2957 - protein, 13 aa, Artificial Sequence
  Description of Artificial Sequence: Synthetic peptide
DIVGPYSSGLFDY

SEQ ID NO: 2958 - protein, 13 aa, Artificial Sequence
  Description of Artificial Sequence: Synthetic peptide
DIRGAYSSGLFDY

SEQ ID NO: 2959 - protein, 13 aa, Artificial Sequence
  Description of Artificial Sequence: Synthetic peptide
DIVGAYSAGLFDY

SEQ ID NO: 2960 - protein, 13 aa, Artificial Sequence
  Description of Artificial Sequence: Synthetic peptide
DIVGPYSAGLFDY

SEQ ID NO: 2961 - protein, 13 aa, Artificial Sequence
  Description of Artificial Sequence: Synthetic peptide
DIRGPYSAGLFDY

SEQ ID NO: 2962 - protein, 13 aa, Artificial Sequence
  Description of Artificial Sequence: Synthetic peptide
DIVGPYSAGLFDY

SEQ ID NO: 2963 - protein, 13 aa, Artificial Sequence
  Description of Artificial Sequence: Synthetic peptide
DIRGAYSSGLFDY

SEQ ID NO: 2964 - protein, 13 aa, Artificial Sequence
  Description of Artificial Sequence: Synthetic peptide
DIVGAYSAGLFDY

SEQ ID NO: 2965 - protein, 13 aa, Artificial Sequence
  Description of Artificial Sequence: Synthetic peptide
DIVGPYSAGLFDY

SEQ ID NO: 2966 - protein, 13 aa, Artificial Sequence
  Description of Artificial Sequence: Synthetic peptide
DIVGPYSAGLFDY

SEQ ID NO: 2967 - protein, 11 aa, Artificial Sequence
  Description of Artificial Sequence: Synthetic peptide
WGRGTLVTVSS

SEQ ID NO: 2968 - protein, 11 aa, Artificial Sequence
  Description of Artificial Sequence: Synthetic peptide
WGRGTLVTVSS

SEQ ID NO: 2969 - protein, 11 aa, Artificial Sequence
  Description of Artificial Sequence: Synthetic peptide
WGRGTLVTVSS

SEQ ID NO: 2970 - protein, 11 aa, Artificial Sequence
  Description of Artificial Sequence: Synthetic peptide
WGRGTLVTVSS

SEQ ID NO: 2971 - protein, 11 aa, Artificial Sequence
  Description of Artificial Sequence: Synthetic peptide
WGRGTLVTVSS

SEQ ID NO: 2972 - protein, 11 aa, Artificial Sequence
  Description of Artificial Sequence: Synthetic peptide
WGRGTLVTVSS

SEQ ID NO: 2973 - protein, 11 aa, Artificial Sequence
  Description of Artificial Sequence: Synthetic peptide
WGRGTLVTVSS

SEQ ID NO: 2974 - protein, 11 aa, Artificial Sequence
  Description of Artificial Sequence: Synthetic peptide
WGRGTLVTVSS

SEQ ID NO: 2975 - protein, 11 aa, Artificial Sequence
  Description of Artificial Sequence: Synthetic peptide
WGRGTLVTVSS

SEQ ID NO: 2976 - protein, 11 aa, Artificial Sequence
  Description of Artificial Sequence: Synthetic peptide
WGRGTLVTVSS

SEQ ID NO: 2977 - protein, 11 aa, Artificial Sequence
  Description of Artificial Sequence: Synthetic peptide
WGRGTLVTVSS

SEQ ID NO: 2978 - protein, 11 aa, Artificial Sequence
  Description of Artificial Sequence: Synthetic peptide
WGRGTLVTVSS

SEQ ID NO: 2979 - protein, 11 aa, Artificial Sequence
  Description of Artificial Sequence: Synthetic peptide
WGRGTLVTVSS

SEQ ID NO: 2980 - protein, 11 aa, Artificial Sequence
  Description of Artificial Sequence: Synthetic peptide
WGRGTLVTVSS

SEQ ID NO: 2981 - protein, 11 aa, Artificial Sequence
  Description of Artificial Sequence: Synthetic peptide
WGRGTLVTVSS

SEQ ID NO: 2982 - protein, 11 aa, Artificial Sequence
  Description of Artificial Sequence: Synthetic peptide
WGRGTLVTVSS

SEQ ID NO: 2983 - protein, 11 aa, Artificial Sequence
  Description of Artificial Sequence: Synthetic peptide
WGRGTLVTVSS

SEQ ID NO: 2984 - protein, 11 aa, Artificial Sequence
  Description of Artificial Sequence: Synthetic peptide
WGRGTLVTVSS

SEQ ID NO: 2985 - protein, 11 aa, Artificial Sequence
  Description of Artificial Sequence: Synthetic peptide
WGRGTLVTVSS

SEQ ID NO: 2986 - protein, 11 aa, Artificial Sequence
  Description of Artificial Sequence: Synthetic peptide
WGRGTLVTVSS

SEQ ID NO: 2987 - protein, 11 aa, Artificial Sequence
  Description of Artificial Sequence: Synthetic peptide
WGRGTLVTVSS

SEQ ID NO: 2988 - protein, 11 aa, Artificial Sequence
  Description of Artificial Sequence: Synthetic peptide
WGRGTLVTVSS

SEQ ID NO: 2989 - protein, 17 aa, Artificial Sequence
  Description of Artificial Sequence: Synthetic peptide
ASTKGPSVFPLAPSSKS

SEQ ID NO: 2990 - protein, 17 aa, Artificial Sequence
  Description of Artificial Sequence: Synthetic peptide
ASTKGPSVFPLAPSSKS

SEQ ID NO: 2991 - protein, 17 aa, Artificial Sequence
  Description of Artificial Sequence: Synthetic peptide
ASTKGPSVFPLAPSSKS

SEQ ID NO: 2992 - protein, 17 aa, Artificial Sequence
  Description of Artificial Sequence: Synthetic peptide
ASTKGPSVFPLAPSSKS

SEQ ID NO: 2993 - protein, 17 aa, Artificial Sequence
  Description of Artificial Sequence: Synthetic peptide
ASTKGPSVFPLAPSSKS

SEQ ID NO: 2994 - protein, 17 aa, Artificial Sequence
  Description of Artificial Sequence: Synthetic peptide
ASTKGPSVFPLAPSSKS

SEQ ID NO: 2995 - protein, 17 aa, Artificial Sequence
  Description of Artificial Sequence: Synthetic peptide
ASTKGPSVFPLAPSSKS

SEQ ID NO: 2996 - protein, 17 aa, Artificial Sequence
  Description of Artificial Sequence: Synthetic peptide
ASTKGPSVFPLAPSSKS

SEQ ID NO: 2997 - protein, 17 aa, Artificial Sequence
  Description of Artificial Sequence: Synthetic peptide
ASTKGPSVFPLAPSSKS

SEQ ID NO: 2998 - protein, 17 aa, Artificial Sequence
  Description of Artificial Sequence: Synthetic peptide
ASTKGPSVFPLAPSSKS

SEQ ID NO: 2999 - protein, 17 aa, Artificial Sequence
  Description of Artificial Sequence: Synthetic peptide
ASTKGPSVFPLAPSSKS

SEQ ID NO: 3000 - protein, 17 aa, Artificial Sequence
  Description of Artificial Sequence: Synthetic peptide
ASTKGPSVFPLAPSSKS

SEQ ID NO: 3001 - protein, 17 aa, Artificial Sequence
  Description of Artificial Sequence: Synthetic peptide
ASTKGPSVFPLAPSLQV

SEQ ID NO: 3002 - protein, 17 aa, Artificial Sequence
  Description of Artificial Sequence: Synthetic peptide
ASTKGPSVFPLAPSSKS

SEQ ID NO: 3003 - protein, 17 aa, Artificial Sequence
  Description of Artificial Sequence: Synthetic peptide
ASTKGPSVFPLAPSSKS

SEQ ID NO: 3004 - protein, 17 aa, Artificial Sequence
  Description of Artificial Sequence: Synthetic peptide
ASTKGPSVFPLAPSSKS

SEQ ID NO: 3005 - protein, 17 aa, Artificial Sequence
  Description of Artificial Sequence: Synthetic peptide
ASTKGPSVFPLAPSSKS

SEQ ID NO: 3006 - protein, 17 aa, Artificial Sequence
  Description of Artificial Sequence: Synthetic peptide
ASTKGPSVFPLAPSSKS

SEQ ID NO: 3007 - protein, 17 aa, Artificial Sequence
  Description of Artificial Sequence: Synthetic peptide
ASTKGPSVFPLAPSSKS

SEQ ID NO: 3008 - protein, 17 aa, Artificial Sequence
  Description of Artificial Sequence: Synthetic peptide
ASTKGPSVFPLAPSSKS

SEQ ID NO: 3009 - protein, 17 aa, Artificial Sequence
  Description of Artificial Sequence: Synthetic peptide
ASTKGPSVFPLAPSSKS

SEQ ID NO: 3010 - protein, 17 aa, Artificial Sequence
  Description of Artificial Sequence: Synthetic peptide
ASTKGPSVFPLAPSSKS

SEQ ID NO: 3011 - protein, 103 aa, Artificial Sequence
  Description of Artificial Sequence: Synthetic polypeptide
DIQMTQSPSSLSASVGDRVTITCRASQSIYTYLNWYQQKPGKAPKLLIYAASSLQSGVPSRFSGSGSGTDFTLTISSLQPEDFATYYCQQAGIFGQGTKLEIK

SEQ ID NO: 3012 - protein, 103 aa, Artificial Sequence; identical to SEQ ID NO: 3011
  Description of Artificial Sequence: Synthetic polypeptide

SEQ ID NO: 3013 - protein, 103 aa, Artificial Sequence; identical to SEQ ID NO: 3011
  Description of Artificial Sequence: Synthetic polypeptide

SEQ ID NO: 3014 - protein, 103 aa, Artificial Sequence; identical to SEQ ID NO: 3011
  Description of Artificial Sequence: Synthetic polypeptide

SEQ ID NO: 3015 - protein, 103 aa, Artificial Sequence; identical to SEQ ID NO: 3011
  Description of Artificial Sequence: Synthetic polypeptide

SEQ ID NO: 3016 - protein, 103 aa, Artificial Sequence; identical to SEQ ID NO: 3011
  Description of Artificial Sequence: Synthetic polypeptide

SEQ ID NO: 3017 - protein, 103 aa, Artificial Sequence
  Description of Artificial Sequence: Synthetic polypeptide
DIQMTQSPSSLSASVGDRVTITCRANQSIYTYLNWYQQKPGKAPKLLIYAASSLQSGVPSRFSGSGSGTDFTLTISSLQPEDFATYYCQQAGIFGQGTKLEIK

SEQ ID NO: 3018 - protein, 103 aa, Artificial Sequence; identical to SEQ ID NO: 3011
  Description of Artificial Sequence: Synthetic polypeptide

SEQ ID NO: 3019 - protein, 103 aa, Artificial Sequence; identical to SEQ ID NO: 3011
  Description of Artificial Sequence: Synthetic polypeptide

SEQ ID NO: 3020 - protein, 103 aa, Artificial Sequence; identical to SEQ ID NO: 3011
  Description of Artificial Sequence: Synthetic polypeptide

SEQ ID NO: 3021 - protein, 103 aa, Artificial Sequence; identical to SEQ ID NO: 3017
  Description of Artificial Sequence: Synthetic polypeptide

SEQ ID NO: 3022 - protein, 103 aa, Artificial Sequence; identical to SEQ ID NO: 3017
  Description of Artificial Sequence: Synthetic polypeptide

SEQ ID NO: 3023 - protein, 103 aa, Artificial Sequence; identical to SEQ ID NO: 3017
  Description of Artificial Sequence: Synthetic polypeptide

SEQ ID NO: 3024 - protein, 103 aa, Artificial Sequence; identical to SEQ ID NO: 3017
  Description of Artificial Sequence: Synthetic polypeptide

SEQ ID NO: 3025 - protein, 103 aa, Artificial Sequence; identical to SEQ ID NO: 3017
  Description of Artificial Sequence: Synthetic polypeptide

SEQ ID NO: 3026 - protein, 103 aa, Artificial Sequence; identical to SEQ ID NO: 3017
  Description of Artificial Sequence: Synthetic polypeptide

SEQ ID NO: 3027 - protein, 103 aa, Artificial Sequence; identical to SEQ ID NO: 3017
  Description of Artificial Sequence: Synthetic polypeptide

SEQ ID NO: 3028 - protein, 103 aa, Artificial Sequence; identical to SEQ ID NO: 3017
  Description of Artificial Sequence: Synthetic polypeptide

SEQ ID NO: 3029 - protein, 103 aa, Artificial Sequence; identical to SEQ ID NO: 3017
  Description of Artificial Sequence: Synthetic polypeptide

SEQ ID NO: 3030 - protein, 103 aa, Artificial Sequence; identical to SEQ ID NO: 3017
  Description of Artificial Sequence: Synthetic polypeptide

SEQ ID NO: 3031 - protein, 103 aa, Artificial Sequence; identical to SEQ ID NO: 3017
  Description of Artificial Sequence: Synthetic polypeptide

SEQ ID NO: 3032 - protein, 103 aa, Artificial Sequence; identical to SEQ ID NO: 3017
  Description of Artificial Sequence: Synthetic polypeptide

SEQ ID NO: 3033 - protein, 122 aa, Artificial Sequence
  Description of Artificial Sequence: Synthetic polypeptide
EVQLLESGGGLVQPGGSLRLSCAASGFTFSDYWMHWVRQAPGKGLEWVSGISPSGGYTHYADSVKGRFTISRDNSKNTLYLQMNSLRAEDTAVYYCARDIVGPYSAGLFDYWGRGTLVTVSS

SEQ ID NO: 3034 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGISPSGGMTHYADSVKGRFTISRDNSKNTLYLQMNSLRAEDTAVYYCARDIVGPYSAGLFDYWGRGTLVTVSS

SEQ ID NO: 3035 - protein, 122 aa, Artificial Sequence
  Description of Artificial Sequence: Synthetic polypeptide
EVQLLESGGGLVQPGGSLRLSCAASGFTFSDYWMHWVRQAPGKGLEWVSGISPSGGYTHYADSVKGRFTISRDNSKNTLYLQMNSLRAEDTAVYYCARDIRGAYSSGLFDYWGRGTLVTVSS

SEQ ID NO: 3036 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGISPSGGMTMYADSVKGRFTISRDNSKNTLYLQMNSLRAEDTAVYYCARDIRGPYSAGLFDYWGRGTLVTVSS

SEQ ID NO: 3037 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGISPSGGMTMYADSVKGRFTISRDNSKNTLYLQMNSLRAEDTAVYYCARDIRGAYSSGLFDYWGRGTLVTVSS

SEQ ID NO: 3038 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGISPSGGYTMYADSVKGRFTISRDNSKNTLYLQMNSLRAEDTAVYYCARDIVGPYSAGLFDYWGRGTLVTVSS

SEQ ID NO: 3039 - protein, 122 aa, Artificial Sequence; identical to SEQ ID NO: 1062
  Description of Artificial Sequence: Synthetic polypeptide

SEQ ID NO: 3040 - protein, 122 aa, Artificial Sequence
  Description of Artificial Sequence: Synthetic polypeptide
EVQLLESGGGLVQPGGSLRLSCAASGFTFSDYWMHWVRQAPGKGLEWVSGISPSGGMTMYADSVKGRFTISRDNSKNTLYLQMNSLRAEDTAVYYCARDIVGPYSAGLFDYWGRGTLVTVSS

SEQ ID NO: 3041 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGISPSGGMTMYADSVKGRFTISRDNSKNTLYLQMNSLRAEDTAVYYCARDIVGAYSAGLFDYWGRGTLVTVSS

SEQ ID NO: 3042 - protein, 122 aa, Artificial Sequence
  Description of Artificial Sequence: Synthetic polypeptide
EVQLLESGGGLVQPGGSLRLSCAASGFTFSWYWMHWVRQAPGKGLEWVSGISPSGGMTMYADSVKGRFTISRDNSKNTLYLQMNSLRAEDTAVYYCARDIVGPYSSGLFDYWGRGTLVTVSS

SEQ ID NO: 3043 - protein, 122 aa, Artificial Sequence; identical to SEQ ID NO: 670
  Description of Artificial Sequence: Synthetic polypeptide

SEQ ID NO: 3044 - protein, 122 aa, Artificial Sequence; identical to SEQ ID NO: 1067
  Description of Artificial Sequence: Synthetic polypeptide

SEQ ID NO: 3045 - protein, 122 aa, Artificial Sequence; identical to SEQ ID NO: 3042
  Description of Artificial Sequence: Synthetic polypeptide

SEQ ID NO: 3046 - protein, 122 aa, Artificial Sequence; identical to SEQ ID NO: 3035
  Description of Artificial Sequence: Synthetic polypeptide

SEQ ID NO: 3047 - protein, 122 aa, Artificial Sequence; identical to SEQ ID NO: 3041
  Description of Artificial Sequence: Synthetic polypeptide

SEQ ID NO: 3048 - protein, 122 aa, Artificial Sequence; identical to SEQ ID NO: 3033
  Description of Artificial Sequence: Synthetic polypeptide

SEQ ID NO: 3049 - protein, 122 aa, Artificial Sequence; identical to SEQ ID NO: 3036
  Description of Artificial Sequence: Synthetic polypeptide

SEQ ID NO: 3050 - protein, 122 aa, Artificial Sequence; identical to SEQ ID NO: 1062
  Description of Artificial Sequence: Synthetic polypeptide

SEQ ID NO: 3051 - protein, 122 aa, Artificial Sequence; identical to SEQ ID NO: 3037
  Description of Artificial Sequence: Synthetic polypeptide

SEQ ID NO: 3052 - protein, 122 aa, Artificial Sequence; identical to SEQ ID NO: 3041
  Description of Artificial Sequence: Synthetic polypeptide

SEQ ID NO: 3053 - protein, 122 aa, Artificial Sequence; identical to SEQ ID NO: 3040
  Description of Artificial Sequence: Synthetic polypeptide

SEQ ID NO: 3054 - protein, 122 aa, Artificial Sequence; identical to SEQ ID NO: 3038
  Description of Artificial Sequence: Synthetic polypeptide

SEQ ID NO: 3055 - protein, 4 aa, Artificial Sequence
  Description of Artificial Sequence: Synthetic peptide
GVHS

SEQ ID NO: 3056 - protein, 4 aa, Artificial Sequence
  Description of Artificial Sequence: Synthetic peptide
GVHS

SEQ ID NO: 3057 - protein, 4 aa, Artificial Sequence
  Description of Artificial Sequence: Synthetic peptide
GVHS

SEQ ID NO: 3058 - protein, 4 aa, Artificial Sequence
  Description of Artificial Sequence: Synthetic peptide
GVHS

SEQ ID NO: 3059 - protein, 4 aa, Artificial Sequence
  Description of Artificial Sequence: Synthetic peptide
GVHS

SEQ ID NO: 3060 - protein, 4 aa, Artificial Sequence
  Description of Artificial Sequence: Synthetic peptide
GVHS

SEQ ID NO: 3061 - protein, 4 aa, Artificial Sequence
  Description of Artificial Sequence: Synthetic peptide
GVHS

SEQ ID NO: 3062 - protein, 4 aa, Artificial Sequence
  Description of Artificial Sequence: Synthetic peptide
GVHS

SEQ ID NO: 3063 - protein, 4 aa, Artificial Sequence
  Description of Artificial Sequence: Synthetic peptide
GVHS

SEQ ID NO: 3064 - protein, 4 aa, Artificial Sequence
  Description of Artificial Sequence: Synthetic peptide
GVHS

SEQ ID NO: 3065 - protein, 4 aa, Artificial Sequence
  Description of Artificial Sequence: Synthetic peptide
GVHS

SEQ ID NO: 3066 - protein, 4 aa, Artificial Sequence
  Description of Artificial Sequence: Synthetic peptide
GVHS

SEQ ID NO: 3067 - protein, 4 aa, Artificial Sequence
  Description of Artificial Sequence: Synthetic peptide
GVHS

SEQ ID NO: 3068 - protein, 4 aa, Artificial Sequence
  Description of Artificial Sequence: Synthetic peptide
GVHS

SEQ ID NO: 3069 - protein, 23 aa, Artificial Sequence
  Description of Artificial Sequence: Synthetic peptide
DIQMTQSPSSLSASVGDRVTITC

SEQ ID NO: 3070 - protein, 23 aa, Artificial Sequence
  Description of Artificial Sequence: Synthetic peptide
DIQMTQSPSSLSASVGDRVTITC

SEQ ID NO: 3071 - protein, 23 aa, Artificial Sequence
  Description of Artificial Sequence: Synthetic peptide
DIQMTQSPSSLSASVGDRVTITC

SEQ ID NO: 3072 - protein, 23 aa, Artificial Sequence
  Description of Artificial Sequence: Synthetic peptide
DIQMTQSPSSLSASVGDRVTITC

SEQ ID NO: 3073 - protein, 23 aa, Artificial Sequence
  Description of Artificial Sequence: Synthetic peptide
DIQMTQSPSSLSASVGDRVTITC

SEQ ID NO: 3074 - protein, 23 aa, Artificial Sequence
  Description of Artificial Sequence: Synthetic peptide
DIQMTQSPSSLSASVGDRVTITC

SEQ ID NO: 3075 - protein, 23 aa, Artificial Sequence
  Description of Artificial Sequence: Synthetic peptide
DIQMTQSPSSLSASVGDRVTITC

SEQ ID NO: 3076 - protein, 23 aa, Artificial Sequence
  Description of Artificial Sequence: Synthetic peptide
DIQMTQSPSSLSASVGDRVTITC

SEQ ID NO: 3077 - protein, 23 aa, Artificial Sequence
  Description of Artificial Sequence: Synthetic peptide
DIQMTQSPSSLSASVGDRVTITC

SEQ ID NO: 3078 - protein, 23 aa, Artificial Sequence
  Description of Artificial Sequence: Synthetic peptide
DIQMTQSPSSLSASVGDRVTITC

SEQ ID NO: 3079 - protein, 23 aa, Artificial Sequence
  Description of Artificial Sequence: Synthetic peptide
DIQMTQSPSSLSASVGDRVTITC

SEQ ID NO: 3080 - protein, 23 aa, Artificial Sequence
  Description of Artificial Sequence: Synthetic peptide
DIQMTQSPSSLSASVGDRVTITC

SEQ ID NO: 3081 - protein, 23 aa, Artificial Sequence
  Description of Artificial Sequence: Synthetic peptide
DIQMTQSPSSLSASVGDRVTITC

SEQ ID NO: 3082 - protein, 23 aa, Artificial Sequence
  Description of Artificial Sequence: Synthetic peptide
DIQMTQSPSSLSASVGDRVTITC

SEQ ID NO: 3083 - protein, 11 aa, Artificial Sequence
  Description of Artificial Sequence: Synthetic peptide
RASQSIYTYLN

SEQ ID NO: 3084 - protein, 11 aa, Artificial Sequence
  Description of Artificial Sequence: Synthetic peptide
RASQSIYTYLN

SEQ ID NO: 3085 - protein, 11 aa, Artificial Sequence
  Description of Artificial Sequence: Synthetic peptide
RASQSIYTYLN

SEQ ID NO: 3086 - protein, 11 aa, Artificial Sequence
  Description of Artificial Sequence: Synthetic peptide
RASQSIYTYLN

SEQ ID NO: 3087 - protein, 11 aa, Artificial Sequence
  Description of Artificial Sequence: Synthetic peptide
RASQSIYTYLN

SEQ ID NO: 3088 - protein, 11 aa, Artificial Sequence
  Description of Artificial Sequence: Synthetic peptide
RASQSIYTYLN

SEQ ID NO: 3089 - protein, 11 aa, Artificial Sequence
  Description of Artificial Sequence: Synthetic peptide
RASQSIYTYLN

SEQ ID NO: 3090 - protein, 11 aa, Artificial Sequence
  Description of Artificial Sequence: Synthetic peptide
RASQSIYTYLN

SEQ ID NO: 3091 - protein, 11 aa, Artificial Sequence
  Description of Artificial Sequence: Synthetic peptide
RASQSIYTYLN

SEQ ID NO: 3092 - protein, 11 aa, Artificial Sequence
  Description of Artificial Sequence: Synthetic peptide
RASQSIYTYLN

SEQ ID NO: 3093 - protein, 11 aa, Artificial Sequence
  Description of Artificial Sequence: Synthetic peptide
RASQSIYTYLN

SEQ ID NO: 3094 - protein, 11 aa, Artificial Sequence
  Description of Artificial Sequence: Synthetic peptide
RASQSIYTYLN

SEQ ID NO: 3095 - protein, 11 aa, Artificial Sequence
  Description of Artificial Sequence: Synthetic peptide
RASQSIYTYLN

SEQ ID NO: 3096 - protein, 11 aa, Artificial Sequence
  Description of Artificial Sequence: Synthetic peptide
RASQSIYTYLN

SEQ ID NO: 3097 - protein, 15 aa, Artificial Sequence
  Description of Artificial Sequence: Synthetic peptide
WYQQKPGKAPKLLIY

SEQ ID NO: 3098 - protein, 15 aa, Artificial Sequence
  Description of Artificial Sequence: Synthetic peptide
WYQQKPGKAPKLLIY

SEQ ID NO: 3099 - protein, 15 aa, Artificial Sequence
  Description of Artificial Sequence: Synthetic peptide
WYQQKPGKAPKLLIY

SEQ ID NO: 3100 - protein, 15 aa, Artificial Sequence
  Description of Artificial Sequence: Synthetic peptide
WYQQKPGKAPKLLIY

SEQ ID NO: 3101 - protein, 15 aa, Artificial Sequence
  Description of Artificial Sequence: Synthetic peptide
WYQQKPGKAPKLLIY

SEQ ID NO: 3102 - protein, 15 aa, Artificial Sequence
  Description of Artificial Sequence: Synthetic peptide
WYQQKPGKAPKLLIY

SEQ ID NO: 3103 - protein, 15 aa, Artificial Sequence
  Description of Artificial Sequence: Synthetic peptide
WYQQKPGKAPKLLIY

SEQ ID NO: 3104 - protein, 15 aa, Artificial Sequence
  Description of Artificial Sequence: Synthetic peptide
WYQQKPGKAPKLLIY

SEQ ID NO: 3105 - protein, 15 aa, Artificial Sequence
  Description of Artificial Sequence: Synthetic peptide
WYQQKPGKAPKLLIY

SEQ ID NO: 3106 - protein, 15 aa, Artificial Sequence
  Description of Artificial Sequence: Synthetic peptide
WYQQKPGKAPKLLIY

SEQ ID NO: 3107 - protein, 15 aa, Artificial Sequence
  Description of Artificial Sequence: Synthetic peptide
WYQQKPGKAPKLLIY

SEQ ID NO: 3108 - protein, 15 aa, Artificial Sequence
  Description of Artificial Sequence: Synthetic peptide
WYQQKPGKAPKLLIY

SEQ ID NO: 3109 - protein, 15 aa, Artificial Sequence
  Description of Artificial Sequence: Synthetic peptide
WYQQKPGKAPKLLIY

SEQ ID NO: 3110 - protein, 15 aa, Artificial Sequence
  Description of Artificial Sequence: Synthetic peptide
WYQQKPGKAPKLLIY

SEQ ID NO: 3111 - protein, 7 aa, Artificial Sequence
  Description of Artificial Sequence: Synthetic peptide
AASSLQS

SEQ ID NO: 3112 - protein, 7 aa, Artificial Sequence
  Description of Artificial Sequence: Synthetic peptide
AASSLQS

SEQ ID NO: 3113 - protein, 7 aa, Artificial Sequence
  Description of Artificial Sequence: Synthetic peptide
AASSLQS

SEQ ID NO: 3114 - protein, 7 aa, Artificial Sequence
  Description of Artificial Sequence: Synthetic peptide
AASSLQS

SEQ ID NO: 3115 - protein, 7 aa, Artificial Sequence
  Description of Artificial Sequence: Synthetic peptide
AASSLQS

SEQ ID NO: 3116 - protein, 7 aa, Artificial Sequence
  Description of Artificial Sequence: Synthetic peptide
AASSLQS

SEQ ID NO: 3117 - protein, 7 aa, Artificial Sequence
  Description of Artificial Sequence: Synthetic peptide
AASSLQS

SEQ ID NO: 3118 - protein, 7 aa, Artificial Sequence
  Description of Artificial Sequence: Synthetic peptide
AASSLQS

SEQ ID NO: 3119 - protein, 7 aa, Artificial Sequence
  Description of Artificial Sequence: Synthetic peptide
AASSLQS

SEQ ID NO: 3120 - protein, 7 aa, Artificial Sequence
  Description of Artificial Sequence: Synthetic peptide
AASSLQS

SEQ ID NO: 3121 - protein, 7 aa, Artificial Sequence
  Description of Artificial Sequence: Synthetic peptide
AASSLQS

SEQ ID NO: 3122 - protein, 7 aa, Artificial Sequence
  Description of Artificial Sequence: Synthetic peptide
AASSLQS

SEQ ID NO: 3123 - protein, 7 aa, Artificial Sequence
  Description of Artificial Sequence: Synthetic peptide
AASSLQS

SEQ ID NO: 3124 - protein, 7 aa, Artificial Sequence
  Description of Artificial Sequence: Synthetic peptide
AASSLQS

SEQ ID NO: 3125 - protein, 32 aa, Artificial Sequence; identical to SEQ ID NO: 186
  Description of Artificial Sequence: Synthetic polypeptide

SEQ ID NO: 3126 - protein, 32 aa, Artificial Sequence; identical to SEQ ID NO: 186
  Description of Artificial Sequence: Synthetic polypeptide

SEQ ID NO: 3127 - protein, 32 aa, Artificial Sequence; identical to SEQ ID NO: 186
  Description of Artificial Sequence: Synthetic polypeptide

SEQ ID NO: 3128 - protein, 32 aa, Artificial Sequence; identical to SEQ ID NO: 186
  Description of Artificial Sequence: Synthetic polypeptide

SEQ ID NO: 3129 - protein, 32 aa, Artificial Sequence; identical to SEQ ID NO: 186
  Description of Artificial Sequence: Synthetic polypeptide

SEQ ID NO: 3130 - protein, 32 aa, Artificial Sequence; identical to SEQ ID NO: 186
  Description of Artificial Sequence: Synthetic polypeptide

SEQ ID NO: 3131 - protein, 32 aa, Artificial Sequence; identical to SEQ ID NO: 186
  Description of Artificial Sequence: Synthetic polypeptide

SEQ ID NO: 3132 - protein, 32 aa, Artificial Sequence; identical to SEQ ID NO: 186
  Description of Artificial Sequence: Synthetic polypeptide

SEQ ID NO: 3133 - protein, 32 aa, Artificial Sequence; identical to SEQ ID NO: 186
  Description of Artificial Sequence: Synthetic polypeptide

SEQ ID NO: 3134 - protein, 32 aa, Artificial Sequence; identical to SEQ ID NO: 186
  Description of Artificial Sequence: Synthetic polypeptide

SEQ ID NO: 3135 - protein, 32 aa, Artificial Sequence; identical to SEQ ID NO: 186
  Description of Artificial Sequence: Synthetic polypeptide

SEQ ID NO: 3136 - protein, 32 aa, Artificial Sequence; identical to SEQ ID NO: 186
  Description of Artificial Sequence: Synthetic polypeptide

SEQ ID NO: 3137 - protein, 32 aa, Artificial Sequence; identical to SEQ ID NO: 186
  Description of Artificial Sequence: Synthetic polypeptide

SEQ ID NO: 3138 - protein, 32 aa, Artificial Sequence; identical to SEQ ID NO: 186
  Description of Artificial Sequence: Synthetic polypeptide

SEQ ID NO: 3139 - protein, 5 aa, Artificial Sequence
  Description of Artificial Sequence: Synthetic peptide
QQAGI

SEQ ID NO: 3140 - protein, 5 aa, Artificial Sequence
  Description of Artificial Sequence: Synthetic peptide
QQAGI

SEQ ID NO: 3141 - protein, 5 aa, Artificial Sequence
  Description of Artificial Sequence: Synthetic peptide
QQAGI

SEQ ID NO: 3142 - protein, 5 aa, Artificial Sequence
  Description of Artificial Sequence: Synthetic peptide
QQAGI

SEQ ID NO: 3143 - protein, 5 aa, Artificial Sequence
  Description of Artificial Sequence: Synthetic peptide
QQAGI

SEQ ID NO: 3144 - protein, 5 aa, Artificial Sequence
  Description of Artificial Sequence: Synthetic peptide
QQAGI

SEQ ID NO: 3145 - protein, 5 aa, Artificial Sequence
  Description of Artificial Sequence: Synthetic peptide
QQAGI

SEQ ID NO: 3146 - protein, 5 aa, Artificial Sequence
  Description of Artificial Sequence: Synthetic peptide
QQAGI

SEQ ID NO: 3147 - protein, 5 aa, Artificial Sequence
  Description of Artificial Sequence: Synthetic peptide
QQAGI

SEQ ID NO: 3148 - protein, 5 aa, Artificial Sequence
  Description of Artificial Sequence: Synthetic peptide
QQAGI

SEQ ID NO: 3149 - protein, 5 aa, Artificial Sequence
  Description of Artificial Sequence: Synthetic peptide
QQAGI

SEQ ID NO: 3150 - protein, 5 aa, Artificial Sequence
  Description of Artificial Sequence: Synthetic peptide
QQAGI

SEQ ID NO: 3151 - protein, 5 aa, Artificial Sequence
  Description of Artificial Sequence: Synthetic peptide
QQAGI

SEQ ID NO: 3152 - protein, 5 aa, Artificial Sequence
  Description of Artificial Sequence: Synthetic peptide
QQAGI

SEQ ID NO: 3153 - protein, 10 aa, Artificial Sequence
  Description of Artificial Sequence: Synthetic peptide
FGQGTKLEIK

SEQ ID NO: 3154 - protein, 10 aa, Artificial Sequence
  Description of Artificial Sequence: Synthetic peptide
FGQGTKLEIK

SEQ ID NO: 3155 - protein, 10 aa, Artificial Sequence
  Description of Artificial Sequence: Synthetic peptide
FGQGTKLEIK

SEQ ID NO: 3156 - protein, 10 aa, Artificial Sequence
  Description of Artificial Sequence: Synthetic peptide
FGQGTKLEIK

SEQ ID NO: 3157 - protein, 10 aa, Artificial Sequence
  Description of Artificial Sequence: Synthetic peptide
FGQGTKLEIK

SEQ ID NO: 3158 - protein, 10 aa, Artificial Sequence
  Description of Artificial Sequence: Synthetic peptide
FGQGTKLEIK

SEQ ID NO: 3159 - protein, 10 aa, Artificial Sequence
  Description of Artificial Sequence: Synthetic peptide
FGQGTKLEIK

SEQ ID NO: 3160 - protein, 10 aa, Artificial Sequence
  Description of Artificial Sequence: Synthetic peptide
FGQGTKLEIK

SEQ ID NO: 3161 - protein, 10 aa, Artificial Sequence
  Description of Artificial Sequence: Synthetic peptide
FGQGTKLEIK

SEQ ID NO: 3162 - protein, 10 aa, Artificial Sequence
  Description of Artificial Sequence: Synthetic peptide
FGQGTKLEIK

SEQ ID NO: 3163 - protein, 10 aa, Artificial Sequence
  Description of Artificial Sequence: Synthetic peptide
FGQGTKLEIK

SEQ ID NO: 3164 - protein, 10 aa, Artificial Sequence
  Description of Artificial Sequence: Synthetic peptide
FGQGTKLEIK

SEQ ID NO: 3165 - protein, 10 aa, Artificial Sequence
  Description of Artificial Sequence: Synthetic peptide
FGQGTKLEIK

SEQ ID NO: 3166 - protein, 10 aa, Artificial Sequence
  Description of Artificial Sequence: Synthetic peptide
FGQGTKLEIK

SEQ ID NO: 3167 - protein, 107 aa, Artificial Sequence [sequence omitted]

SEQ ID NO: 3168 - protein, 107 aa, Artificial Sequence [sequence omitted]

SEQ ID NO: 3169 - protein, 107 aa, Artificial Sequence [sequence omitted]

SEQ ID NO: 3170 - protein, 107 aa, Artificial Sequence [sequence omitted]

SEQ ID NO: 3171 - protein, 107 aa, Artificial Sequence [sequence omitted]

SEQ ID NO: 3172 - protein, 107 aa, Artificial Sequence [sequence omitted]

SEQ ID NO: 3173 - protein, 107 aa, Artificial Sequence [sequence omitted]

SEQ ID NO: 3174 - protein, 107 aa, Artificial Sequence [sequence omitted]

SEQ ID NO: 3175 - protein, 107 aa, Artificial Sequence [sequence omitted]

SEQ ID NO: 3176 - protein, 107 aa, Artificial Sequence [sequence omitted]

SEQ ID NO: 3177 - protein, 107 aa, Artificial Sequence [sequence omitted]

SEQ ID NO: 3178 - protein, 107 aa, Artificial Sequence [sequence omitted]

SEQ ID NO: 3179 - protein, 107 aa, Artificial Sequence [sequence omitted]

SEQ ID NO: 3180 - protein, 107 aa, Artificial Sequence [sequence omitted]

SEQ ID NO: 3181 - protein, 19 aa, Artificial Sequence
  Description of Artificial Sequence: Synthetic peptide
MGWSCIILFLVATATGAHS

SEQ ID NO: 3182 - protein, 19 aa, Artificial Sequence
  Description of Artificial Sequence: Synthetic peptide
MGWSCIILFLVATATGAHS

SEQ ID NO: 3183 - protein, 19 aa, Artificial Sequence
  Description of Artificial Sequence: Synthetic peptide
MGWSCIILFLVATATGAHS

SEQ ID NO: 3184 - protein, 19 aa, Artificial Sequence
  Description of Artificial Sequence: Synthetic peptide
MGWSCIILFLVATATGAHS

SEQ ID NO: 3185 - protein, 19 aa, Artificial Sequence
  Description of Artificial Sequence: Synthetic peptide
MGWSCIILFLVATATGAHS

SEQ ID NO: 3186 - protein, 19 aa, Artificial Sequence
  Description of Artificial Sequence: Synthetic peptide
MGWSCIILFLVATATGAHS

SEQ ID NO: 3187 - protein, 19 aa, Artificial Sequence
  Description of Artificial Sequence: Synthetic peptide
MGWSCIILFLVATATGAHS

SEQ ID NO: 3188 - protein, 19 aa, Artificial Sequence
  Description of Artificial Sequence: Synthetic peptide
MGWSCIILFLVATATGAHS

SEQ ID NO: 3189 - protein, 19 aa, Artificial Sequence
  Description of Artificial Sequence: Synthetic peptide
MGWSCIILFLVATATGAHS

SEQ ID NO: 3190 - protein, 19 aa, Artificial Sequence
  Description of Artificial Sequence: Synthetic peptide
MGWSCIILFLVATATGAHS

SEQ ID NO: 3191 - protein, 19 aa, Artificial Sequence
  Description of Artificial Sequence: Synthetic peptide
MGWSCIILFLVATATGAHS

SEQ ID NO: 3192 - protein, 19 aa, Artificial Sequence
  Description of Artificial Sequence: Synthetic peptide
MGWSCIILFLVATATGAHS

SEQ ID NO: 3193 - protein, 19 aa, Artificial Sequence
  Description of Artificial Sequence: Synthetic peptide
MGWSCIILFLVATATGAHS

SEQ ID NO: 3194 - protein, 19 aa, Artificial Sequence
  Description of Artificial Sequence: Synthetic peptide
MGWSCIILFLVATATGAHS

SEQ ID NO: 3195 - protein, 30 aa, Artificial Sequence; identical to SEQ ID NO: 322
  Description of Artificial Sequence: Synthetic polypeptide

SEQ ID NO: 3196 - protein, 30 aa, Artificial Sequence; identical to SEQ ID NO: 322
  Description of Artificial Sequence: Synthetic polypeptide

SEQ ID NO: 3197 - protein, 30 aa, Artificial Sequence; identical to SEQ ID NO: 322
  Description of Artificial Sequence: Synthetic polypeptide

SEQ ID NO: 3198 - protein, 30 aa, Artificial Sequence; identical to SEQ ID NO: 322
  Description of Artificial Sequence: Synthetic polypeptide

SEQ ID NO: 3199 - protein, 30 aa, Artificial Sequence; identical to SEQ ID NO: 322
  Description of Artificial Sequence: Synthetic polypeptide

SEQ ID NO: 3200 - protein, 30 aa, Artificial Sequence; identical to SEQ ID NO: 322
  Description of Artificial Sequence: Synthetic polypeptide

SEQ ID NO: 3201 - protein, 30 aa, Artificial Sequence; identical to SEQ ID NO: 322
  Description of Artificial Sequence: Synthetic polypeptide

SEQ ID NO: 3202 - protein, 30 aa, Artificial Sequence; identical to SEQ ID NO: 322
  Description of Artificial Sequence: Synthetic polypeptide

SEQ ID NO: 3203 - protein, 30 aa, Artificial Sequence; identical to SEQ ID NO: 322
  Description of Artificial Sequence: Synthetic polypeptide

SEQ ID NO: 3204 - protein, 30 aa, Artificial Sequence; identical to SEQ ID NO: 322
  Description of Artificial Sequence: Synthetic polypeptide

SEQ ID NO: 3205 - protein, 30 aa, Artificial Sequence; identical to SEQ ID NO: 322
  Description of Artificial Sequence: Synthetic polypeptide

SEQ ID NO: 3206 - protein, 30 aa, Artificial Sequence; identical to SEQ ID NO: 322
  Description of Artificial Sequence: Synthetic polypeptide

SEQ ID NO: 3207 - protein, 30 aa, Artificial Sequence; identical to SEQ ID NO: 322
  Description of Artificial Sequence: Synthetic polypeptide

SEQ ID NO: 3208 - protein, 30 aa, Artificial Sequence; identical to SEQ ID NO: 322
  Description of Artificial Sequence: Synthetic polypeptide

SEQ ID NO: 3209 - protein, 5 aa, Artificial Sequence
  Description of Artificial Sequence: Synthetic peptide
DYWMH

SEQ ID NO: 3210 - protein, 5 aa, Artificial Sequence
  Description of Artificial Sequence: Synthetic peptide
DYWLH

SEQ ID NO: 3211 - protein, 5 aa, Artificial Sequence
  Description of Artificial Sequence: Synthetic peptide
DYWTH

SEQ ID NO: 3212 - protein, 5 aa, Artificial Sequence
  Description of Artificial Sequence: Synthetic peptide
DYWMH

SEQ ID NO: 3213 - protein, 5 aa, Artificial Sequence
  Description of Artificial Sequence: Synthetic peptide
DYWMH

SEQ ID NO: 3214 - protein, 5 aa, Artificial Sequence
  Description of Artificial Sequence: Synthetic peptide
DYWMH

SEQ ID NO: 3215 - protein, 5 aa, Artificial Sequence
  Description of Artificial Sequence: Synthetic peptide
DYWLH

SEQ ID NO: 3216 - protein, 5 aa, Artificial Sequence
  Description of Artificial Sequence: Synthetic peptide
DYWMH

SEQ ID NO: 3217 - protein, 5 aa, Artificial Sequence
  Description of Artificial Sequence: Synthetic peptide
DYWLH

SEQ ID NO: 3218 - protein, 5 aa, Artificial Sequence
  Description of Artificial Sequence: Synthetic peptide
DYWTH

SEQ ID NO: 3219 - protein, 5 aa, Artificial Sequence
  Description of Artificial Sequence: Synthetic peptide
DYWMH

SEQ ID NO: 3220 - protein, 5 aa, Artificial Sequence
  Description of Artificial Sequence: Synthetic peptide
DYWMH

SEQ ID NO: 3221 - protein, 5 aa, Artificial Sequence
  Description of Artificial Sequence: Synthetic peptide
DYWMH

SEQ ID NO: 3222 - protein, 5 aa, Artificial Sequence
  Description of Artificial Sequence: Synthetic peptide
DYWLH

SEQ ID NO: 3223 - protein, 14 aa, Artificial Sequence
  Description of Artificial Sequence: Synthetic peptide
WVRQAPGKGLEWVS

SEQ ID NO: 3224 - protein, 14 aa, Artificial Sequence
  Description of Artificial Sequence: Synthetic peptide
WVRQAPGKGLEWVS

SEQ ID NO: 3225 - protein, 14 aa, Artificial Sequence
  Description of Artificial Sequence: Synthetic peptide
WVRQAPGKGLEWVS

SEQ ID NO: 3226 - protein, 14 aa, Artificial Sequence
  Description of Artificial Sequence: Synthetic peptide
WVRQAPGKGLEWVS

SEQ ID NO: 3227 - protein, 14 aa, Artificial Sequence
  Description of Artificial Sequence: Synthetic peptide
WVRQAPGKGLEWVS

SEQ ID NO: 3228 - protein, 14 aa, Artificial Sequence
  Description of Artificial Sequence: Synthetic peptide
WVRQAPGKGLEWVS

SEQ ID NO: 3229 - protein, 14 aa, Artificial Sequence
  Description of Artificial Sequence: Synthetic peptide
WVRQAPGKGLEWVS

SEQ ID NO: 3230 - protein, 14 aa, Artificial Sequence
  Description of Artificial Sequence: Synthetic peptide
WVRQAPGKGLEWVS

SEQ ID NO: 3231 - protein, 14 aa, Artificial Sequence
  Description of Artificial Sequence: Synthetic peptide
WVRQAPGKGLEWVS

SEQ ID NO: 3232 - protein, 14 aa, Artificial Sequence
  Description of Artificial Sequence: Synthetic peptide
WVRQAPGKGLEWVS

SEQ ID NO: 3233 - protein, 14 aa, Artificial Sequence
  Description of Artificial Sequence: Synthetic peptide
WVRQAPGKGLEWVS

SEQ ID NO: 3234 - protein, 14 aa, Artificial Sequence
  Description of Artificial Sequence: Synthetic peptide
WVRQAPGKGLEWVS

SEQ ID NO: 3235 - protein, 14 aa, Artificial Sequence
  Description of Artificial Sequence: Synthetic peptide
WVRQAPGKGLEWVS

SEQ ID NO: 3236 - protein, 14 aa, Artificial Sequence
  Description of Artificial Sequence: Synthetic peptide
WVRQAPGKGLEWVS

SEQ ID NO: 3237 - protein, 17 aa, Artificial Sequence
  Description of Artificial Sequence: Synthetic peptide
GISPSGGMTMYADSVKG

SEQ ID NO: 3238 - protein, 17 aa, Artificial Sequence
  Description of Artificial Sequence: Synthetic peptide
GISPSGGMTMYADSVKG

SEQ ID NO: 3239 - protein, 17 aa, Artificial Sequence
  Description of Artificial Sequence: Synthetic peptide
GISPSGGMTMYADSVKG

SEQ ID NO: 3240 - protein, 17 aa, Artificial Sequence
  Description of Artificial Sequence: Synthetic peptide
GISPSGGSTMYADSVKG

SEQ ID NO: 3241 - protein, 17 aa, Artificial Sequence
  Description of Artificial Sequence: Synthetic peptide
GISPSGGMTYYADSVKG

SEQ ID NO: 3242 - protein, 17 aa, Artificial Sequence
  Description of Artificial Sequence: Synthetic peptide
GISPSGGSTYYADSVKG

SEQ ID NO: 3243 - protein, 17 aa, Artificial Sequence
  Description of Artificial Sequence: Synthetic peptide
GISPSGGSTYYADSVKG

SEQ ID NO: 3244 - protein, 17 aa, Artificial Sequence
  Description of Artificial Sequence: Synthetic peptide
GISGSGGMTMYADSVKG

SEQ ID NO: 3245 - protein, 17 aa, Artificial Sequence
  Description of Artificial Sequence: Synthetic peptide
GISGSGGMTMYADSVKG

SEQ ID NO: 3246 - protein, 17 aa, Artificial Sequence
  Description of Artificial Sequence: Synthetic peptide
GISGSGGMTMYADSVKG

SEQ ID NO: 3247 - protein, 17 aa, Artificial Sequence
  Description of Artificial Sequence: Synthetic peptide
GISGSGGSTMYADSVKG

SEQ ID NO: 3248 - protein, 17 aa, Artificial Sequence
  Description of Artificial Sequence: Synthetic peptide
GISGSGGMTYYADSVKG

SEQ ID NO: 3249 - protein, 17 aa, Artificial Sequence
  Description of Artificial Sequence: Synthetic peptide
GISGSGGSTYYADSVKG

SEQ ID NO: 3250 - protein, 17 aa, Artificial Sequence
  Description of Artificial Sequence: Synthetic peptide
GISGSGGSTYYADSVKG

SEQ ID NO: 3251 - protein, 32 aa, Artificial Sequence; identical to SEQ ID NO: 952
  Description of Artificial Sequence: Synthetic polypeptide

SEQ ID NO: 3252 - protein, 32 aa, Artificial Sequence; identical to SEQ ID NO: 952
  Description of Artificial Sequence: Synthetic polypeptide

SEQ ID NO: 3253 - protein, 32 aa, Artificial Sequence; identical to SEQ ID NO: 952
  Description of Artificial Sequence: Synthetic polypeptide

SEQ ID NO: 3254 - protein, 32 aa, Artificial Sequence; identical to SEQ ID NO: 952
  Description of Artificial Sequence: Synthetic polypeptide

SEQ ID NO: 3255 - protein, 32 aa, Artificial Sequence; identical to SEQ ID NO: 952
  Description of Artificial Sequence: Synthetic polypeptide

SEQ ID NO: 3256 - protein, 32 aa, Artificial Sequence; identical to SEQ ID NO: 952
  Description of Artificial Sequence: Synthetic polypeptide

SEQ ID NO: 3257 - protein, 32 aa, Artificial Sequence; identical to SEQ ID NO: 952
  Description of Artificial Sequence: Synthetic polypeptide

SEQ ID NO: 3258 - protein, 32 aa, Artificial Sequence; identical to SEQ ID NO: 952
  Description of Artificial Sequence: Synthetic polypeptide

SEQ ID NO: 3259 - protein, 32 aa, Artificial Sequence; identical to SEQ ID NO: 952
  Description of Artificial Sequence: Synthetic polypeptide

SEQ ID NO: 3260 - protein, 32 aa, Artificial Sequence; identical to SEQ ID NO: 952
  Description of Artificial Sequence: Synthetic polypeptide

SEQ ID NO: 3261 - protein, 32 aa, Artificial Sequence; identical to SEQ ID NO: 952
  Description of Artificial Sequence: Synthetic polypeptide

SEQ ID NO: 3262 - protein, 32 aa, Artificial Sequence; identical to SEQ ID NO: 952
  Description of Artificial Sequence: Synthetic polypeptide

SEQ ID NO: 3263 - protein, 32 aa, Artificial Sequence; identical to SEQ ID NO: 952
  Description of Artificial Sequence: Synthetic polypeptide

SEQ ID NO: 3264 - protein, 32 aa, Artificial Sequence; identical to SEQ ID NO: 952
  Description of Artificial Sequence: Synthetic polypeptide

SEQ ID NO: 3265 - protein, 13 aa, Artificial Sequence
  Description of Artificial Sequence: Synthetic peptide
DIVGPYSAGLFDY

SEQ ID NO: 3266 - protein, 13 aa, Artificial Sequence
  Description of Artificial Sequence: Synthetic peptide
DIVGPYSAGLFDY

SEQ ID NO: 3267 - protein, 13 aa, Artificial Sequence
  Description of Artificial Sequence: Synthetic peptide
DIVGPYSAGLFDY

SEQ ID NO: 3268 - protein, 13 aa, Artificial Sequence
  Description of Artificial Sequence: Synthetic peptide
DIVGPYSAGLFDY

SEQ ID NO: 3269 - protein, 13 aa, Artificial Sequence
  Description of Artificial Sequence: Synthetic peptide
DIVGPYSAGLFDY

SEQ ID NO: 3270 - protein, 13 aa, Artificial Sequence
  Description of Artificial Sequence: Synthetic peptide
DIVGPYSAGLFDY

SEQ ID NO: 3271 - protein, 13 aa, Artificial Sequence
  Description of Artificial Sequence: Synthetic peptide
DIVGPYSAGLFDY

SEQ ID NO: 3272 - protein, 13 aa, Artificial Sequence
  Description of Artificial Sequence: Synthetic peptide
DIVGPYSAGLFDY

SEQ ID NO: 3273 - protein, 13 aa, Artificial Sequence
  Description of Artificial Sequence: Synthetic peptide
DIVGPYSAGLFDY

SEQ ID NO: 3274 - protein, 13 aa, Artificial Sequence
  Description of Artificial Sequence: Synthetic peptide
DIVGPYSAGLFDY

SEQ ID NO: 3275 - protein, 13 aa, Artificial Sequence
  Description of Artificial Sequence: Synthetic peptide
DIVGPYSAGLFDY

SEQ ID NO: 3276 - protein, 13 aa, Artificial Sequence
  Description of Artificial Sequence: Synthetic peptide
DIVGPYSAGLFDY

SEQ ID NO: 3277 - protein, 13 aa, Artificial Sequence
  Description of Artificial Sequence: Synthetic peptide
DIVGPYSAGLFDY

SEQ ID NO: 3278 - protein, 13 aa, Artificial Sequence
  Description of Artificial Sequence: Synthetic peptide
DIVGPYSAGLFDY

SEQ ID NO: 3279 - protein, 11 aa, Artificial Sequence
  Description of Artificial Sequence: Synthetic peptide
WGRGTLVTVSS

SEQ ID NO: 3280 - protein, 11 aa, Artificial Sequence
  Description of Artificial Sequence: Synthetic peptide
WGRGTLVTVSS

SEQ ID NO: 3281 - protein, 11 aa, Artificial Sequence
  Description of Artificial Sequence: Synthetic peptide
WGRGTLVTVSS

SEQ ID NO: 3282 - protein, 11 aa, Artificial Sequence
  Description of Artificial Sequence: Synthetic peptide
WGRGTLVTVSS

SEQ ID NO: 3283 - protein, 11 aa, Artificial Sequence
  Description of Artificial Sequence: Synthetic peptide
WGRGTLVTVSS

SEQ ID NO: 3284 - protein, 11 aa, Artificial Sequence
  Description of Artificial Sequence: Synthetic peptide
WGRGTLVTVSS

SEQ ID NO: 3285 - protein, 11 aa, Artificial Sequence
  Description of Artificial Sequence: Synthetic peptide
WGRGTLVTVSS

SEQ ID NO: 3286 - protein, 11 aa, Artificial Sequence
  Description of Artificial Sequence: Synthetic peptide
WGRGTLVTVSS

SEQ ID NO: 3287 - protein, 11 aa, Artificial Sequence
  Description of Artificial Sequence: Synthetic peptide
WGRGTLVTVSS

SEQ ID NO: 3288 - protein, 11 aa, Artificial Sequence
  Description of Artificial Sequence: Synthetic peptide
WGRGTLVTVSS

SEQ ID NO: 3289 - protein, 11 aa, Artificial Sequence
  Description of Artificial Sequence: Synthetic peptide
WGRGTLVTVSS

SEQ ID NO: 3290 - protein, 11 aa, Artificial Sequence
  Description of Artificial Sequence: Synthetic peptide
WGRGTLVTVSS

SEQ ID NO: 3291 - protein, 11 aa, Artificial Sequence
  Description of Artificial Sequence: Synthetic peptide
WGRGTLVTVSS

SEQ ID NO: 3292 - protein, 11 aa, Artificial Sequence
  Description of Artificial Sequence: Synthetic peptide
WGRGTLVTVSS

SEQ ID NO: 3293 - protein, 17 aa, Artificial Sequence
  Description of Artificial Sequence: Synthetic peptide
ASTKGPSVFPLAPSSKS

SEQ ID NO: 3294 - protein, 17 aa, Artificial Sequence
  Description of Artificial Sequence: Synthetic peptide
ASTKGPSVFPLAPSSKS

SEQ ID NO: 3295 - protein, 17 aa, Artificial Sequence
  Description of Artificial Sequence: Synthetic peptide
ASTKGPSVFPLAPSSKS

SEQ ID NO: 3296 - protein, 17 aa, Artificial Sequence
  Description of Artificial Sequence: Synthetic peptide
ASTKGPSVFPLAPSSKS

SEQ ID NO: 3297 - protein, 17 aa, Artificial Sequence
  Description of Artificial Sequence: Synthetic peptide
ASTKGPSVFPLAPSSKS

SEQ ID NO: 3298 - protein, 17 aa, Artificial Sequence
  Description of Artificial Sequence: Synthetic peptide
ASTKGPSVFPLAPSSKS

SEQ ID NO: 3299 - protein, 17 aa, Artificial Sequence
  Description of Artificial Sequence: Synthetic peptide
ASTKGPSVFPLAPSSKS

SEQ ID NO: 3300 - protein, 17 aa, Artificial Sequence
  Description of Artificial Sequence: Synthetic peptide
ASTKGPSVFPLAPSSKS

SEQ ID NO: 3301 - protein, 17 aa, Artificial Sequence
  Description of Artificial Sequence: Synthetic peptide
ASTKGPSVFPLAPSSKS

SEQ ID NO: 3302 - protein, 17 aa, Artificial Sequence
  Description of Artificial Sequence: Synthetic peptide
ASTKGPSVFPLAPSSKS

SEQ ID NO: 3303 - protein, 17 aa, Artificial Sequence
  Description of Artificial Sequence: Synthetic peptide
ASTKGPSVFPLAPSSKS

SEQ ID NO: 3304 - protein, 17 aa, Artificial Sequence
  Description of Artificial Sequence: Synthetic peptide
ASTKGPSVFPLAPSSKS

SEQ ID NO: 3305 - protein, 17 aa, Artificial Sequence
  Description of Artificial Sequence: Synthetic peptide
ASTKGPSVFPLAPSSKS

SEQ ID NO: 3306 - protein, 17 aa, Artificial Sequence
  Description of Artificial Sequence: Synthetic peptide
ASTKGPSVFPLAPSSKS

SEQ ID NO: 3307 - protein, 103 aa, Artificial Sequence; identical to SEQ ID NO: 3011
  Description of Artificial Sequence: Synthetic polypeptide

SEQ ID NO: 3308 - protein, 103 aa, Artificial Sequence; identical to SEQ ID NO: 3011
  Description of Artificial Sequence: Synthetic polypeptide

SEQ ID NO: 3309 - protein, 103 aa, Artificial Sequence; identical to SEQ ID NO: 3011
  Description of Artificial Sequence: Synthetic polypeptide

SEQ ID NO: 3310 - protein, 103 aa, Artificial Sequence; identical to SEQ ID NO: 3011
  Description of Artificial Sequence: Synthetic polypeptide

SEQ ID NO: 3311 - protein, 103 aa, Artificial Sequence; identical to SEQ ID NO: 3011
  Description of Artificial Sequence: Synthetic polypeptide

SEQ ID NO: 3312 - protein, 103 aa, Artificial Sequence; identical to SEQ ID NO: 3011
  Description of Artificial Sequence: Synthetic polypeptide

SEQ ID NO: 3313 - protein, 103 aa, Artificial Sequence; identical to SEQ ID NO: 3011
  Description of Artificial Sequence: Synthetic polypeptide

SEQ ID NO: 3314 - protein, 103 aa, Artificial Sequence; identical to SEQ ID NO: 3011
  Description of Artificial Sequence: Synthetic polypeptide

SEQ ID NO: 3315 - protein, 103 aa, Artificial Sequence; identical to SEQ ID NO: 3011
  Description of Artificial Sequence: Synthetic polypeptide

SEQ ID NO: 3316 - protein, 103 aa, Artificial Sequence; identical to SEQ ID NO: 3011
  Description of Artificial Sequence: Synthetic polypeptide

SEQ ID NO: 3317 - protein, 103 aa, Artificial Sequence; identical to SEQ ID NO: 3011
  Description of Artificial Sequence: Synthetic polypeptide

SEQ ID NO: 3318 - protein, 103 aa, Artificial Sequence; identical to SEQ ID NO: 3011
  Description of Artificial Sequence: Synthetic polypeptide

SEQ ID NO: 3319 - protein, 103 aa, Artificial Sequence; identical to SEQ ID NO: 3011
  Description of Artificial Sequence: Synthetic polypeptide

SEQ ID NO: 3320 - protein, 103 aa, Artificial Sequence; identical to SEQ ID NO: 3011
  Description of Artificial Sequence: Synthetic polypeptide

SEQ ID NO: 3321 - protein, 122 aa, Artificial Sequence; identical to SEQ ID NO: 3040
  Description of Artificial Sequence: Synthetic polypeptide

SEQ ID NO: 3322 - protein, 122 aa, Artificial Sequence
  Description of Artificial Sequence: Synthetic polypeptide
EVQLLESGGGLVQPGGSLRLSCAASGFTFSDYWLHWVRQAPGKGLEWVSGISPSGGMTMYADSVKGRFTISRDNSKNTLYLQMNSLRAEDTAVYYCARDIVGPYSAGLFDYWGRGTLVTVSS

SEQ ID NO: 3323 - protein, 122 aa, Artificial Sequence
  Description of Artificial Sequence: Synthetic polypeptide
EVQLLESGGGLVQPGGSLRLSCAASGFTFSDYWTHWVRQAPGKGLEWVSGISPSGGMTMYADSVKGRFTISRDNSKNTLYLQMNSLRAEDTAVYYCARDIVGPYSAGLFDYWGRGTLVTVSS

SEQ ID NO: 3324 - protein, 122 aa, Artificial Sequence
  Description of Artificial Sequence: Synthetic polypeptide
EVQLLESGGGLVQPGGSLRLSCAASGFTFSDYWMHWVRQAPGKGLEWVSGISPSGGSTMYADSVKGRFTISRDNSKNTLYLQMNSLRAEDTAVYYCARDIVGPYSAGLFDYWGRGTLVTVSS

SEQ ID NO: 3325 - protein, 122 aa, Artificial Sequence
  Description of Artificial Sequence: Synthetic polypeptide
EVQLLESGGGLVQPGGSLRLSCAASGFTFSDYWMHWVRQAPGKGLEWVSGISPSGGMTYYADSVKGRFTISRDNSKNTLYLQMNSLRAEDTAVYYCARDIVGPYSAGLFDYWGRGTLVTVSS

SEQ ID NO: 3326 - protein, 122 aa, Artificial Sequence
  Description of Artificial Sequence: Synthetic polypeptide
EVQLLESGGGLVQPGGSLRLSCAASGFTFSDYWMHWVRQAPGKGLEWVSGISPSGGSTYYADSVKGRFTISRDNSKNTLYLQMNSLRAEDTAVYYCARDIVGPYSAGLFDYWGRGTLVTVSS

SEQ ID NO: 3327 - protein, 122 aa, Artificial Sequence
  Description of Artificial Sequence: Synthetic polypeptide
EVQLLESGGGLVQPGGSLRLSCAASGFTFSDYWLHWVRQAPGKGLEWVSGISPSGGSTYYADSVKGRFTISRDNSKNTLYLQMNSLRAEDTAVYYCARDIVGPYSAGLFDYWGRGTLVTVSS

SEQ ID NO: 3328 - protein, 122 aa, Artificial Sequence
  Description of Artificial Sequence: Synthetic polypeptide
EVQLLESGGGLVQPGGSLRLSCAASGFTFSDYWMHWVRQAPGKGLEWVSGISGSGGMTMYADSVKGRFTISRDNSKNTLYLQMNSLRAEDTAVYYCARDIVGPYSAGLFDYWGRGTLVTVSS

SEQ ID NO: 3329 - protein, 122 aa, Artificial Sequence
  Description of Artificial Sequence: Synthetic polypeptide
EVQLLESGGGLVQPGGSLRLSCAASGFTFSDYWLHWVRQAPGKGLEWVSGISGSGGMTMYADSVKGRFTISRDNSKNTLYLQMNSLRAEDTAVYYCARDIVGPYSAGLFDYWGRGTLVTVSS

SEQ ID NO: 3330 - protein, 122 aa, Artificial Sequence
  Description of Artificial Sequence: Synthetic polypeptide
EVQLLESGGGLVQPGGSLRLSCAASGFTFSDYWTHWVRQAPGKGLEWVSGISGSGGMTMYADSVKGRFTISRDNSKNTLYLQMNSLRAEDTAVYYCARDIVGPYSAGLFDYWGRGTLVTVSS

SEQ ID NO: 3331 - protein, 122 aa, Artificial Sequence
  Description of Artificial Sequence: Synthetic polypeptide
EVQLLESGGGLVQPGGSLRLSCAASGFTFSDYWMHWVRQAPGKGLEWVSGISGSGGSTMYADSVKGRFTISRDNSKNTLYLQMNSLRAEDTAVYYCARDIVGPYSAGLFDYWGRGTLVTVSS

SEQ ID NO: 3332 - protein, 122 aa, Artificial Sequence
  Description of Artificial Sequence: Synthetic polypeptide
EVQLLESGGGLVQPGGSLRLSCAASGFTFSDYWMHWVRQAPGKGLEWVSGISGSGGMTYYADSVKGRFTISRDNSKNTLYLQMNSLRAEDTAVYYCARDIVGPYSAGLFDYWGRGTLVTVSS

SEQ ID NO: 3333 - protein, 122 aa, Artificial Sequence
  Description of Artificial Sequence: Synthetic polypeptide
EVQLLESGGGLVQPGGSLRLSCAASGFTFSDYWMHWVRQAPGKGLEWVSGISGSGGSTYYADSVKGRFTISRDNSKNTLYLQMNSLRAEDTAVYYCARDIVGPYSAGLFDYWGRGTLVTVSS

SEQ ID NO: 3334 - protein, 122 aa, Artificial Sequence
  Description of Artificial Sequence: Synthetic polypeptide
EVQLLESGGGLVQPGGSLRLSCAASGFTFSDYWLHWVRQAPGKGLEWVSGISGSGGSTYYADSVKGRFTISRDNSKNTLYLQMNSLRAEDTAVYYCARDIVGPYSAGLFDYWGRGTLVTVSS

SEQ ID NO: 3335 - protein, 5 aa, Artificial Sequence
  Description of Artificial Sequence: Synthetic peptide
DYNMH

SEQ ID NO: 3336 - protein, 5 aa, Artificial Sequence
  Description of Artificial Sequence: Synthetic peptide
WYMMG

SEQ ID NO: 3337 - protein, 5 aa, Artificial Sequence
  Description of Artificial Sequence: Synthetic peptide
PYWMH

SEQ ID NO: 3338 - protein, 5 aa, Artificial Sequence
  Description of Artificial Sequence: Synthetic peptide
PYWMS

SEQ ID NO: 3339 - protein, 5 aa, Artificial Sequence
  Description of Artificial Sequence: Synthetic peptide
WYWMV

SEQ ID NO: 3340 - protein, 5 aa, Artificial Sequence
  Description of Artificial Sequence: Synthetic peptide
YYGMG

SEQ ID NO: 3341 - protein, 5 aa, Artificial Sequence
  Description of Artificial Sequence: Synthetic peptide
WYWMH

SEQ ID NO: 3342 - protein, 5 aa, Artificial Sequence
  Description of Artificial Sequence: Synthetic peptide
WYNMS

SEQ ID NO: 3343 - protein, 5 aa, Artificial Sequence
  Description of Artificial Sequence: Synthetic peptide
YYNMH

SEQ ID NO: 3344 - protein, 5 aa, Artificial Sequence
  Description of Artificial Sequence: Synthetic peptide
EYWMY

SEQ ID NO: 3345 - protein, 5 aa, Artificial Sequence
  Description of Artificial Sequence: Synthetic peptide
PYWMH

SEQ ID NO: 3346 - protein, 5 aa, Artificial Sequence
  Description of Artificial Sequence: Synthetic peptide
LYHMH

SEQ ID NO: 3347 - protein, 5 aa, Artificial Sequence
  Description of Artificial Sequence: Synthetic peptide
PYWMH

SEQ ID NO: 3348 - protein, 5 aa, Artificial Sequence
  Description of Artificial Sequence: Synthetic peptide
WYNMH

SEQ ID NO: 3349 - protein, 5 aa, Artificial Sequence
  Description of Artificial Sequence: Synthetic peptide
WYWMV

SEQ ID NO: 3350 - protein, 5 aa, Artificial Sequence
  Description of Artificial Sequence: Synthetic peptide
DYNMH

SEQ ID NO: 3351 - protein, 5 aa, Artificial Sequence
  Description of Artificial Sequence: Synthetic peptide
WYWMH

SEQ ID NO: 3352 - protein, 5 aa, Artificial Sequence
  Description of Artificial Sequence: Synthetic peptide
EYNMH

SEQ ID NO: 3353 - protein, 5 aa, Artificial Sequence
  Description of Artificial Sequence: Synthetic peptide
WYWMH

SEQ ID NO: 3354 - protein, 5 aa, Artificial Sequence
  Description of Artificial Sequence: Synthetic peptide
WYGMH

SEQ ID NO: 3355 - protein, 5 aa, Artificial Sequence
  Description of Artificial Sequence: Synthetic peptide
YYNMH

SEQ ID NO: 3356 - protein, 5 aa, Artificial Sequence
  Description of Artificial Sequence: Synthetic peptide
EYNMH

SEQ ID NO: 3357 - protein, 17 aa, Artificial Sequence
  Description of Artificial Sequence: Synthetic peptide
YIGPSGGYTHYADSVKG

SEQ ID NO: 3358 - protein, 17 aa, Artificial Sequence
  Description of Artificial Sequence: Synthetic peptide
SISPSGGYTFYADSVKG

SEQ ID NO: 3359 - protein, 17 aa, Artificial Sequence
  Description of Artificial Sequence: Synthetic peptide
GIGPSGGLTFYADSVKG

SEQ ID NO: 3360 - protein, 17 aa, Artificial Sequence
  Description of Artificial Sequence: Synthetic peptide
GISPSGGITFYADSVKG

SEQ ID NO: 3361 - protein, 17 aa, Artificial Sequence
  Description of Artificial Sequence: Synthetic peptide
SIGPSGGDTYYADSVKG

SEQ ID NO: 3362 - protein, 17 aa, Artificial Sequence
  Description of Artificial Sequence: Synthetic peptide
VISSSGGFTFYADSVKG

SEQ ID NO: 3363 - protein, 17 aa, Artificial Sequence
  Description of Artificial Sequence: Synthetic peptide
GIVSSGGTTIYADSVKG

SEQ ID NO: 3364 - protein, 17 aa, Artificial Sequence
  Description of Artificial Sequence: Synthetic peptide
RISPSGGDTGYADSVKG

SEQ ID NO: 3365 - protein, 17 aa, Artificial Sequence
  Description of Artificial Sequence: Synthetic peptide
GIGPSGGGTLYADSVKG

SEQ ID NO: 3366 - protein, 17 aa, Artificial Sequence
  Description of Artificial Sequence: Synthetic peptide
GISPSGGMTFYADSVKG

SEQ ID NO: 3367 - protein, 17 aa, Artificial Sequence
  Description of Artificial Sequence: Synthetic peptide
GIGPSGGPTFYADSIKG

SEQ ID NO: 3368 - protein, 17 aa, Artificial Sequence
  Description of Artificial Sequence: Synthetic peptide
GIGPSGGWTIYADSVKG

SEQ ID NO: 3369 - protein, 17 aa, Artificial Sequence
  Description of Artificial Sequence: Synthetic peptide
GISSSGGDTLYADSVKG

SEQ ID NO: 3370 - protein, 17 aa, Artificial Sequence
  Description of Artificial Sequence: Synthetic peptide
GISPSGGNTSYADSVKG

SEQ ID NO: 3371 - protein, 17 aa, Artificial Sequence
  Description of Artificial Sequence: Synthetic peptide
SIVPSGGFTIYADSVKG

SEQ ID NO: 3372 - protein, 17 aa, Artificial Sequence
  Description of Artificial Sequence: Synthetic peptide
YIGPSGGYTHYADSVKG

SEQ ID NO: 3373 - protein, 17 aa, Artificial Sequence
  Description of Artificial Sequence: Synthetic peptide
GIYSSGGDTIYADSVKG

SEQ ID NO: 3374 - protein, 17 aa, Artificial Sequence
  Description of Artificial Sequence: Synthetic peptide
GIVPSGGLTHYADSVKG

SEQ ID NO: 3375 - protein, 17 aa, Artificial Sequence
  Description of Artificial Sequence: Synthetic peptide
GISPSGGMTMYADSVKG

SEQ ID NO: 3376 - protein, 17 aa, Artificial Sequence
  Description of Artificial Sequence: Synthetic peptide
GIVSSGGETFYADSVKG

SEQ ID NO: 3377 - protein, 17 aa, Artificial Sequence
  Description of Artificial Sequence: Synthetic peptide
GISPSGGTTFYADSVKG

SEQ ID NO: 3378 - protein, 17 aa, Artificial Sequence
  Description of Artificial Sequence: Synthetic peptide
GIVPSGGLTHYADSVKG

SEQ ID NO: 3379 - protein, 13 aa, Artificial Sequence
  Description of Artificial Sequence: Synthetic peptide
DIRGAYSSGLFDY

SEQ ID NO: 3380 - protein, 13 aa, Artificial Sequence
  Description of Artificial Sequence: Synthetic peptide
DIRGAYSSGLFDY

SEQ ID NO: 3381 - protein, 13 aa, Artificial Sequence
  Description of Artificial Sequence: Synthetic peptide
DIRGAYSSGLFDY

SEQ ID NO: 3382 - protein, 13 aa, Artificial Sequence
  Description of Artificial Sequence: Synthetic peptide
DIRGAYSSGLFDY

SEQ ID NO: 3383 - protein, 13 aa, Artificial Sequence
  Description of Artificial Sequence: Synthetic peptide
DIRGAYSSGLFDY

SEQ ID NO: 3384 - protein, 13 aa, Artificial Sequence
  Description of Artificial Sequence: Synthetic peptide
DIRGAYSSGLFDY

SEQ ID NO: 3385 - protein, 13 aa, Artificial Sequence
  Description of Artificial Sequence: Synthetic peptide
DIRGAYSSGLFDY

SEQ ID NO: 3386 - protein, 13 aa, Artificial Sequence
  Description of Artificial Sequence: Synthetic peptide
DIRGAYSSGLFDY

SEQ ID NO: 3387 - protein, 13 aa, Artificial Sequence
  Description of Artificial Sequence: Synthetic peptide
DIRGAYSSGLFDY

SEQ ID NO: 3388 - protein, 13 aa, Artificial Sequence
  Description of Artificial Sequence: Synthetic peptide
DIRGAYSSGLFDY

SEQ ID NO: 3389 - protein, 13 aa, Artificial Sequence
  Description of Artificial Sequence: Synthetic peptide
DIRGAYSSGLFDY

SEQ ID NO: 3390 - protein, 13 aa, Artificial Sequence
  Description of Artificial Sequence: Synthetic peptide
DIRGAYSSGLFDY

SEQ ID NO: 3391 - protein, 13 aa, Artificial Sequence
  Description of Artificial Sequence: Synthetic peptide
DIRGAYSSGLFDY

SEQ ID NO: 3392 - protein, 13 aa, Artificial Sequence
  Description of Artificial Sequence: Synthetic peptide
DIRGAYSSGLFDY

SEQ ID NO: 3393 - protein, 13 aa, Artificial Sequence
  Description of Artificial Sequence: Synthetic peptide
DIRGAYSSGLFDY

SEQ ID NO: 3394 - protein, 13 aa, Artificial Sequence
  Description of Artificial Sequence: Synthetic peptide
DIRGAYASGLFDY

SEQ ID NO: 3395 - protein, 13 aa, Artificial Sequence
  Description of Artificial Sequence: Synthetic peptide
DIRGPHSSGLFDY

SEQ ID NO: 3396 - protein, 13 aa, Artificial Sequence
  Description of Artificial Sequence: Synthetic peptide
DIRGAYSSGLFDY

SEQ ID NO: 3397 - protein, 13 aa, Artificial Sequence
  Description of Artificial Sequence: Synthetic peptide
DIVGPYSAGLFDY

SEQ ID NO: 3398 - protein, 13 aa, Artificial Sequence
  Description of Artificial Sequence: Synthetic peptide
DIRGVFLSGLFDH

SEQ ID NO: 3399 - protein, 13 aa, Artificial Sequence
  Description of Artificial Sequence: Synthetic peptide
DITGAYSAGLFDL

SEQ ID NO: 3400 - protein, 13 aa, Artificial Sequence
  Description of Artificial Sequence: Synthetic peptide
DIRGAYSAGIFDY

SEQ ID NO: 3401 - protein, 7 aa, Artificial Sequence
  Description of Artificial Sequence: Synthetic peptide
  MOD_RES (1)..(1): 7-Methoxycoumarin-4-acetyl-Pro
  MOD_RES (5)..(5): Diaminopropionyl(dinitrophenyl)
PLGLXAR

SEQ ID NO: 3402 - protein, 11 aa, Artificial Sequence
  Description of Artificial Sequence: Synthetic peptide
RANQSIYTYLN

What is claimed is:

1. An isolated Matrix Metalloproteinase-12 (MMP-12) specific monoclonal antibody, wherein the monoclonal antibody binds an epitope bound by an antibody having a heavy chain (HC) immunoglobulin variable domain sequence of SEQ ID NO. 1825 and a light chain (LC) immunoglobulin variable domain sequence of SEQ ID NO: 608.

2. The monoclonal antibody of claim 1, wherein the monoclonal antibody binds human MMP-12.

3. The monoclonal antibody of claim 1, wherein the monoclonal antibody inhibits the catalytic activity of MMP-12.

4. The monoclonal antibody of claim 1, wherein the monoclonal antibody guides a nano-particle or toxin to a cell expressing MMP-12 on the cell surface.

5. The monoclonal antibody of claim 1, wherein
the HC immunoglobulin variable domain sequence comprises a CDR1, CDR2 and CDR3 having the amino acid sequence of SEQ ID NO: 14, SEQ ID No. 936, and SEQ ID NO: 995, respectively; and
the LC immunoglobulin variable domain sequence comprises a CDR1, CDR2 and CDR3 having the amino acid sequence of SEQ ID NO: 84, SEQ ID NO: 152, and SEQ ID NO: 220, respectively.

6. The monoclonal antibody of claim 1, wherein the monoclonal antibody comprises the light and heavy chains of SEQ ID NO:608 and SEQ ID NO: 1825, respectively.

7. A pharmaceutical composition comprising an MMP-12 specific monoclonal antibody of claim 1 and a pharmaceutically acceptable carrier.

8. The monoclonal antibody of claim 5, wherein the monoclonal antibody comprises the light chain of SEQ ID NO: 608.

9. The monoclonal antibody of claim 5, wherein the monoclonal antibody comprises the light chain of SEQ ID NO: 1825.

* * * * *

UNITED STATES PATENT AND TRADEMARK OFFICE
CERTIFICATE OF CORRECTION

| | | |
|---|---|---|
| PATENT NO. | : 8,114,968 B2 | Page 1 of 1 |
| APPLICATION NO. | : 12/397258 | |
| DATED | : February 14, 2012 | |
| INVENTOR(S) | : Devy et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 326 days.

Signed and Sealed this
Nineteenth Day of June, 2012

David J. Kappos
*Director of the United States Patent and Trademark Office*